US 12,428,649 B2

(12) United States Patent
Baum et al.

(10) Patent No.: US 12,428,649 B2
(45) Date of Patent: Sep. 30, 2025

(54) METHODS AND COMPOSITIONS FOR MAKING AND USING COMPATIBLE INSECTICIDAL PROTEINS

(71) Applicant: Monsanto Technology LLC, St. Louis, MO (US)

(72) Inventors: James A. Baum, Webster Groves, MO (US); Artem G. Evdokimov, Orchard Park, NY (US); Agoston Jerga, Chesterfield, MO (US); Farhad Moshiri, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 790 days.

(21) Appl. No.: 17/677,648

(22) Filed: Feb. 22, 2022

(65) Prior Publication Data
US 2022/0243221 A1     Aug. 4, 2022

Related U.S. Application Data

(62) Division of application No. 16/296,886, filed on Mar. 8, 2019, now abandoned.

(60) Provisional application No. 62/640,927, filed on Mar. 9, 2018.

(51) Int. Cl.
*C12N 15/82* (2006.01)
*G01N 33/50* (2006.01)

(52) U.S. Cl.
CPC ..... *C12N 15/8286* (2013.01); *G01N 33/5085* (2013.01); *G01N 2333/43552* (2013.01)

(58) Field of Classification Search
CPC ........... C12N 15/8286; G01N 33/5085; G01N 2333/43552
See application file for complete search history.

(56) References Cited

U.S. PATENT DOCUMENTS

| | | | |
|---|---|---|---|
| 5,500,365 A | 3/1996 | Fischhoff et al. | |
| 5,866,784 A | 2/1999 | Van Mellaert et al. | |
| 8,344,207 B2 | 1/2013 | Bogdanova et al. | |
| 9,121,035 B2 | 9/2015 | Baum et al. | |
| 9,322,033 B2 | 4/2016 | Baum et al. | |
| 10,188,115 B2 | 1/2019 | Baum et al. | |
| 10,897,910 B2 | 1/2021 | Baum et al. | |
| 2010/0180351 A1 | 7/2010 | Gossele et al. | |
| 2011/0318272 A1* | 12/2011 | Street | A01N 53/00 424/9.2 |
| 2013/0269060 A1 | 10/2013 | Baum et al. | |
| 2015/0047076 A1* | 2/2015 | Anderson | C12N 15/8286 435/417 |
| 2015/0274786 A1* | 10/2015 | Bowen | A01N 63/50 514/4.5 |

OTHER PUBLICATIONS

Badran et al., "Continuous evolution of Bacillus thuringiensis toxins overcomes insect resistance," Nature 533 (7601):58-63, 2016.
Bates et al., "Insect resistance management in GM crops: past, present and future," Nat. Biotechnol. 1:57-62, 2005.
Carrière et al., "Optimizing pyramided transgenic Bt crops for sustainable pest management," Nat. Biotechnol. 33:161-168, 2015.
De et al., "Crystal structure of the Vibrio cholerae cytolysin heptamer reveals common features among disparate pore-forming toxins," Proc. Natl. Acad. Sci. 108:7385-7390, 2011.
De Maagd et al, "Structure, diversity, and evolution of protein toxins from spore-forming entomopathogenic bacteria," Annu. Rev. Genet. 37:409-433, 2003.
Deitloff et al., "Effects of refuges on the evolution of resistance to transgenic corn by western corn rootworm, *Diabrotica virgifera virgifera* LeConte," Pest Management Science, 2015.
Devos et al. "Resistance evolution to plant-produced Bt-toxins of the first generation of genetically engineered Diabrotica-active Bt-maize events by western corn rootworm: management and monitoring considerations," ISB News Report Agricultural and Environmental Biotechnology, 2013.
Estela et al., "Interaction of Bacillus thuringiensis toxins with larval midgut binding sites of Helicoverpa armigera (Lepidoptera: Noctuidae)," Appl. Environ. Microbiol. 70(3):1378-1384, 2004.
Girard et al., "Cysteine scanning mutagenesis of 4, a putative pore-lining helix of the Bacillus thuringiensis insecticidal toxin Cry1Aa," Applied and Environmental Microbiology 74(9):2565-2572, 2008.
Girard et al., "Helix α4 of the Bacillus thuringiensis Cry1aa toxin plays a critical role in the postbinding steps of pore formation," Applied and Environmental Microbiology 75(2):359-365, 2009.

(Continued)

*Primary Examiner* — Jianfeng Song
(74) *Attorney, Agent, or Firm* — Dentons US LLP

(57) ABSTRACT

Pesticidal proteins (FFPP's) are used to produce derivatives (DP's) that are ineffective and disabled relative to conferring toxic properties upon a target pest, yet the ability of the DP to bind to the receptor to which said FFPP binds is unaffected. Such DP's are useful in inhibiting the FFPP from which it was derived when both are fed to a target pest and for comparing receptor binding capability and efficiency relative to different FFPP's from which the DP has been derived, providing for an assessment of different FFPP's relative to each other, and providing uniformity and certainty in combinations of such FFPP's for compositions, including transgenic plants, that can be used to control pest populations susceptible to both FFPP's, creating more durable transgenic plant products, inhibiting the development of resistance to such FFPP's when used in plants commercially, and in providing a durable and viable resistance management strategy for crops using such FFPP combinations. Polynucleotide sequences intended for use in expression of the DP's and FFPP's are also provided. Particular embodiments provide methods of designing and preparing DP's, as well as compositions and methods of using DP's and the FFPP's from which the DP's have been derived in more effective pesticidal compositions and products.

8 Claims, No Drawings

Specification includes a Sequence Listing.

(56) References Cited

OTHER PUBLICATIONS

González-Cabrera et al., "Binding of Bacillus thuringiensis toxins in resistant and susceptible strains of pink bollworm (*Pectinophora gossypiella*)," Insect Biochemistry and Molecular Biology, 33:929-935, 2003.

Gowda et al., "A transgenic approach for controlling Lygus in cotton," Nature Communications 12213, 2016.

Granero et al., "Bacillus thuringiensis crystal proteins Cry1Ab and Cry1Fa share a high affinity binding site in *Plutella xylostella* (L.)," Biochemical and Biophysical Research Communications, 224:779-783, 1996.

Jimenez-Juarez et al., "Bacillus thuringiensis Cry1Ab mutants affecting oligomer formation are non-toxic to Manduca sexta larvae," J Biol. Chem. 282(29): 21222-9, 2007.

Jurat-Fuentes et al., "Specificity determinants for Cry insecticidal proteins: Insights from their mode of action," J. Invertebr. Pathol. 142:5-10, 2017.

Melo et al., "Bacillus thuringiensis: mechanism of action, resistance, and new applications: a review," Crit Rev Biotechnol. 36(2):317-26, 2014.

Pardo-Lopez et al., "Bacillus thuringiensis insecticidal three-domain Cry toxins: mode of action, insect resistance and consequences for crop protection," FEMS Microbiology Reviews 37(1): 3-22, 2013.

Rodríguez-Almazán et al., "Dominant negative mutants of Bacillus thuringiensis Cry1Ab toxin function as anti-toxins: demonstration of the role of oligomerization in toxicity," PloS One 4(5):e5545, 2009.

Siebert et al., Evaluation of corn hybrids expressing Cry1F, Cry1A. 105, Cry2Ab2, Cry34Ab1/Cry35Ab1, and Cry3Bb1 against southern United States insect pests, Journal of Economic Entomology 105(5):1825-1834, 2012.

Schwartz et al., "Restriction of intramolecular movements within the Cry1Aa toxin molecule of Bacillus thuringiensis through disulfide bond engineering," FEBS Letters 410:397-402, 1997.

Tabashnik, "Pest adaptation," Nature 389: 778, 1997.

Tabashnik et al., "Suppressing resistance to Bt cotton with sterile insect releases," Nat. Biotechnol. 28(12):1304-7, 2010.

Tabashnik et al.,"Insect resistance to Bt crops: lessons from the first billion acres," Nat. Biotechnol. 31(6):510-21, 2013.

Tanaka et al.,"2-Methyl-2,4-pentanediol induces spontaneous assembly of *Staphylococcal* α-hemolysin into heptameric pore structure," Protein Science 20:448-456, 2011.

Vachon et al., "Helix 4 mutants of the Bacillus thuringiensis insecticidal toxin Cry1Aa display altered pore-forming abilities," Applied and Environmental Microbiology 70(10):6123-6130, 2004.

Zhao et al., "Transgenic plants expressing two Bacillus thuringiensis toxins delay insect resistance evolution," Nat. Biotechnol. 21:1493-1497, 2003.

\* cited by examiner

METHODS AND COMPOSITIONS FOR MAKING AND USING COMPATIBLE INSECTICIDAL PROTEINS

CROSS-REFERENCE TO RELATED APPLICATIONS

This application is a divisional of co-pending US Patent Application Ser. No. 16/296,886, filed Mar. 8, 2019, which application claims the benefit of U.S. Provisional Application No. 62/640,927, filed Mar. 9, 2018, each of the disclosures which is specifically incorporated herein by reference in their entirety.

INCORPORATION OF SEQUENCE LISTING

A computer readable form of the Sequence Listing is filed herewith by electronic submission. The Sequence Listing is incorporated by reference in its entirety, is contained in the file created on Feb. 22, 2022 having the file name MONS493USD1_ST25.txt, and which is 716,120 bytes in size (as measured in the MS-Windows® operating system).

FIELD OF THE INVENTION

The invention generally relates to the field of pest inhibitory proteins. Generally, a method is provided for selecting two or more toxin proteins (each being different from the other by at least one amino acid, and each being toxic to the same target pest) that are compatible with each other and which can be used collectively (i) in a composition such as in an agriculturally acceptable formulation for topical application on, or expressed in, a plant for controlling said target pest; (ii) for diminishing the likelihood of the development of resistance to any of the compatible toxin proteins; (iii) in a pesticidally effective/agriculturally acceptable composition produced in or applied, alone or separately, to a plant; (iv) in a plant or in a composition for the purposes of protecting a plant from infestation by said target pest; (v) in a composition or in a plant for the purpose of decreasing the likelihood of the development of resistance by said target pest to any one of the compatible toxin proteins; (vi) in a composition or in a plant for the purpose of aiding in or improving resistance management practices for controlling said target pest; (vii) in a composition or in a plant for the purpose of delaying the onset of resistance to any of the compatible toxins; and in other unique applications for pest management. In particular, the design, production and useful applications for such compatible protein toxins are provided, as well as compositions and methods for the same.

BACKGROUND OF THE INVENTION

Plant pests, such as numerous species of plant parasitic nematodes, mites, and a plethora of chewing, cutting, boring, and piercing and sucking insects, are the most significant contributors to decreased crop yields. in an attempt to reduce such pest infestation, various chemical and biological approaches have been developed. Chemical insecticides have been successful and have been used extensively. However, most chemical insecticides lack specificity and persist in the environment, exerting toxic effects on non-target species including humans and animals.

Insect-protected row crops expressing insecticidal proteins (IPs) derived from the entomopathogenic bacterium Bacillus thuringiensis (Bt) have transformed farming practices in many countries (Abrol and Shankar 2012). The insecticidal traits resulting from transgene expression of IPs provide these crops with robust and effective protection from insect herbivory, a benefit that even extends to non-transgenic crops grown in proximity to the transgenic crops, due to area-wide insect pest suppression (Tabashnik 2010). Bt proteins expressed in plants may be used in their native form or after considerable engineering and improvement (Siebert 2012, Koch 2015, Badran, Guzov et al. 2016, Gowda 2016). Bt protein toxins as well as other toxin proteins that have been recently identified from diverse species of microbes, are highly selective and do not persist in the environment, which is in stark contrast to chemical approaches for controlling pest infestation, particularly insect pest infestation. Bt toxin proteins, when ingested by a susceptible insect, become activated by gut proteases, bind to cognate receptors in the insect gut, and form transmembrane pores that eventually kill the insect (Vachon 2012, Pardo-Lopez 2013). A diverse set of such toxin proteins has been discovered. Each protein has generally demonstrated specific toxic activity against a narrow range of insect species. For example, Cry1 proteins are observed to exhibit toxic effects generally against Lepidopteran species, Cry3 proteins are generally observed to exhibit toxic effects against Coleopteran species, and yet other more recently identified protein toxins from these sorts of microbes exhibit specific activities against species such as Hymenoptera, Diptera, and Heteroptera species. As is the case for synthetic insecticides, insect pest populations can evolve resistance to commercially available insecticidal proteins, each of which at one time were capable of controlling the applicable target pest before the development of resistance (Tabashnik 2013, Melo 2016). This is largely due to widespread adoption of crop plants containing such toxin proteins for targeted insect pest control, coupled with poor to non-existent resistance management practices, non-compliance with government regulatory recommendations, and illegal use activities. There are many mechanisms through which resistance could emerge, but the dominant phenomenon seems to be receptor-mediated wherein the resistant insects exhibit alterations in key receptors or lower their expression such that the toxin is no longer recognized (Tabashnik B. E. 1997, Tabashnik 2013, Melo 2016). Accepted strategies for curtailing insect resistance development include the planting of a non-transgenic refuge and deploying insect resistance traits that operate via different mechanisms of action (MOA), which are typically characterized as differences in receptor binding (Devos, Meihls et al. 2013, Carriére Y. 2015, Deitloff, Dunbar et al. 2016). These methods reduce the chance that a single target pest will evolve resistance to one or more of the toxins being used. The discovery of new efficacious IPs that target insect receptors distinct from those that are recognized by currently deployed IPs in commercial insect-protected crops is of paramount importance for the sustainability of this pest management strategy (Zhao J. Z. 2003, Bates S. L. 2005), particularly as a result of increasing human populations and decreasing availability of arable land.

Theoretically, Bt proteins as well as other toxins derived from microbes that resemble and/or act in a similar manner as Bt proteins, are all believed to initiate their toxic effect upon ingestion by the target insect pest of a food source or diet in which the toxic protein is present, and thereafter entering the insect gut and binding to brush border membrane proteins that act as receptors for bringing the toxin close to the membrane surface. Membrane-bound toxin molecules then undergo structural transition and likely also, aggregation, to form transmembrane pores which lead to insect injury (i.e., morbidity) and death. Through natural adaptation and selection, pest populations, including insect populations, evolve resistance to such pesticidal proteins. It is believed that alterations in receptor binding by the applicable toxin is the major mechanism in development of resistant pest species, including insect species. As a result, it is important to identify new IPs for deployment in next-generation insect-protected crops that bind to receptors in a target pest, including in a target insect pest, that are different in comparison to receptors used by other toxins which are also effective in the same target pest. (Granero F. 1996, González-Cabrera J. 2003, Estela 2004, Jurat-Fuentes 2017). There are several published methods used to study IP MOA including ligand blots (Keeton, Francis et al. 1998, Banks, Jurat-Fuentes et al. 2001), in vitro binding experiments with labeled IPs (Jakka 2015) and isolated insect gut brush-border membrane vesicle (BBMV) preparations (Martin and Wolfersberger 1995), pull-down experiments using immobilized or immuno-precipitated 1Ps (Luo, Sangadala et al. 1997), insect cell-based assays using cloned insect receptor genes (Tanaka 2013, Onofre J. 2017), and the use of resistant insect colonies (Tabashnik B. E. 2000, Tabashnik, Johnson et al. 2000, Herrero, Oppert et al. 2001, Siqueira, Moellenbeck et al. 2004). Apart from resistant colonies, the aforementioned methods provide only a partial representation of an IP's receptor preferences due to the highly challenging and complex nature of the systems under study. Given the rapidly increasing numbers of known IPs (Bravo 2012), there is a need for a simple, inexpensive, and robust method for MOA differentiation across multiple insect species.

U.S. Pat. No. 5,866,784 (Van Mellaert et al.) discloses combining two or more Bt's different from each other that bind non-specifically to receptors on the surface of a target insects' isolated and purified brush border membranes and which do not compete for the same receptor. U.S. Pat. No. 5,500,365 (Fischhoff and Perlak) discloses that Bt toxins active against the same insect can be combined to provide at least additive insecticidal efficacy, and may provide a synergistic activity, and because of the distinct amino acid sequence between two different proteins, each may provide a distinct mode of action. The prior art teaches identification of toxins that exhibit toxic effects against a single target pest using in vitro bioassay methods which include preparation of brush border membrane vesicles from the specific target pest, testing a first toxin's ability to bind to the membrane vesicles and determining a saturation point at which no additional first toxin is capable of binding the vesicles, then testing a second toxin for its ability to compete with the binding of the first toxin by adding sequentially increasing amounts of said second toxin to a sample of vesicles saturated with said first toxin, and making a determination about whether said second toxin is capable of binding to the same receptor as said first toxin. There is no mechanism for efficiently selecting, in vivo in a target pest, two different toxin proteins that each confer a unique mode of action against the target pest and which do not compete for the same toxin receptor in said pest.

Toxins that each confer morbidity and mortality upon a single target pest and which are determined by the methods hereunder to bind to different receptors in the target pest or which do not interfere with the steps leading to pesticidal activity are, by default, compatible toxins, i.e., toxins that belong to a single compatibility group. Two different FFPP's, a first and a second, can be compared for compatibility by comparing independently the efficacy of any disabled protein (DP) for reducing lethality (morbidity and mortality) of either FFPP provided in the diet of a target pest and determining that the DP interferes with the toxic properties conferred upon a target pest by a first FFPP from which such DP has been derived, and does not interfere with the toxic properties conferred upon the same target pest by a second FFPP, so long as both FFPP's are independently demonstrated to cause morbidity and mortality to the target pest, such FFPP's are compatible for use in a composition on or in a plant for controlling the target pest by providing at least two different independent modes of action.

As a result, the methods disclosed herein and proteins identified as being compatible with each other, fulfill a critical unmet need for efficient, effective, rapid discovery and development of effective compatible pesticidal proteins for producing pest-free crops that are unlikely to give rise to the development of target pest races which have developed resistance to such toxic proteins.

SUMMARY OF THE INVENTION

The present invention provides for a first polypeptide that exhibits receptor binding characteristics that are indistinguishable from that of a second polypeptide that is different from the first polypeptide by at least a single amino acid, yet both polypeptides are toxic to the same insect species. Except for the receptor binding characteristics of the first polypeptide, the first polypeptide inhibits the natural biological function of the second polypeptide when both are provided together in a composition. The first polypeptide is devoid of the biological function of the second polypeptide. The first polypeptide amino acid sequence exhibits preferably from about 98 per cent to about 99.4 percent or greater identity to the amino acid sequence of the second polypeptide amino acid sequence. The first polypeptide may exhibit a natural biological function that is an insecticidal activity against an insect pest of a crop plant. The insect pest may be selected from the group consisting of a lepidopteran pest species, a coleopteran pest species, a hemipteran pest species, a homopteran pest species, and a dipteran pest species, and the crop plant may be selected from the group consisting of a dicot and a monocot crop plant. The second polypeptide may be selected from the group consisting of a *Bacillus thuringiensis* species insecticidal toxin protein, a *brevibacillus* species toxin protein, a *xenorhabdus* species toxin protein, a *photorhabdus* species toxin protein, a *Bacillus latcrosporous* species toxin protein, and a *pseudomonas* species toxin protein.

The present invention also provides a disabled polypeptide (DT) that is derived from a fully functional pesticidal polypeptide (FFPP). The pesticidal activity of the FFPP on a target pest is dependent upon the FFPP binding to a target pest receptor (TPR) in the gut of the target pest. The DT is preferably derived by the steps of (a) introducing one or more amino acid sequence modifications into a pore forming segment of the FFPP to diminish or eliminate the ability of the FFPP to direct pore formation; optionally the one or more modifications within the amino acid sequence may be introduced at a location which results in a reduction of toxic effect of the resulting DT to the target pest without affecting binding of the DT to the naturally occurring TPR, and the resulting modified amino acid sequence of the modified FFPP is the amino acid sequence of the DT;

(b) comparing separately and together the toxic potency of the unmodified FFPP and the DP when provided alone and in various proportions together to said target pest;

(c) observing that the DP, when used alone, exhibits a substantially diminished toxic effect upon said target pest compared to the unmodified FFPP, and (d) observing that the DP, when used in a plurality of molar ratios with a constant amount of unmodified FFPP, is effective in titering the toxic effect of the FFPP upon said target pest.

The invention also provides for selecting two or more FFPP's that are each toxic to a common target insect species, and the two or more FFPP's that are selected can be combined together in a composition or combined together for use on or in a plant to control insect infestation of the plant by a target insect pest species. The combination of the plurality of FFPP's optionally provides (i) for decreasing the likelihood of the development of resistance by the target insect pest to any of the FFPP's in the composition; (ii) for aiding in or improving resistance management practices for controlling the target insect pest; or (iii) for delaying the onset of resistance to any of the FFPP's in the composition. The two or more FFPP's are preferably selected by the steps of:

(a) introducing one or more amino acid sequence modifications into a pore forming segment of at least one of a first FFPP to diminish or eliminate said first FFPP's pore formation, (said one or more modifications being introduced at a location which results in a reduction of toxic effect of the resulting DP to the target pest without affecting binding to the naturally occurring TPR) the resulting modified amino acid sequence comprising the DT;

(b) comparing separately and together the toxic potency of the unmodified first FFPP and the DP when provided alone and in various proportions together to said target pest;

(c) observing that the DP, when used alone, exhibits a substantially diminished toxic effect upon said target pest compared to the unmodified first FFPP;

(d) observing that the DP, when used in a plurality of molar ratios with a constant amount of unmodified first FFPP, is effective in titering the toxic effect of the first FFPP upon said target pest; and (e) observing that said DP, when used in a plurality of molar ratios with a constant amount of an unmodified second FFPP different from said first FFPP, does not titer the toxic effect of the second FFPP upon said target pest.

The result is that the first and second FFPP's are thus compatible for use together in the composition on or in the plant.

A DP, derived from a FFPP wherein the pesticidal activity of the FFPP on the target pest depends on the FFPP binding to a target pest receptor (TPR), and wherein the DP has one or more amino acid modifications in a domain of the FFPP at a location which results in reduced toxicity to the target pest without affecting binding to said TPR when compared to the FFPP. A method of assessing the mode of action of a first FFPP for compatibility with a second FFPP to be used in a common pesticidal composition, said method comprising the steps of:

(a) preparing a DP from a first FFPP that is toxic to a target pest;

(b) confirming that said DP when used alone in a bioassay with said target pest has diminished toxicity against the target pest when compared to the toxicity of the first FFPP;

(c) comparing said DP to a second FFPP different from said first FFPP alone and in a plurality of molar ratios in which the DP is present in a greater concentration than said second FFPP in the diet of the target pest, wherein the inability to titer the toxic properties of said second FFPP with said DP is determinative of the binding of said first FFPP and said second FFPP to different receptors in said target pest.

Also provides are pesticidal protein toxins, wherein the pesticidal activity of the pesticidal protein toxin is suppressed, partially or fully, in the presence of a polypeptide comprising an amino acid sequence having about 95-99.98% identity to said pesticidal protein amino acid sequence.

The methods of the present invention provide for a composition comprising said first FFPP and said second FFPP is effective in controlling an insect pest infestation wherein said insects arc selected from the group consisting of Arachnida, Coleoptera, Ctenocephalides, Diptera, Hemiptera, Heteroptera, Homoptera, Hymenoptera, Lepidoptera and Thysanoptera insects.

The invention also provides for a plant or a seed from a plant comprising a first recombinant nucleic acid molecule comprising a first heterologous promoter operably linked to a first polynucleotide segment encoding a first FFPP and a second recombinant nucleic acid molecule comprising a second heterologous promoter operably linked to a second polynucleotide segment encoding a second FFPP different from said first FFPP, wherein said first FFPP and said second FFPP are selected for use together from the steps as set forth in any of the embodiments above, wherein, optionally:

(a) said plant or said seed are produced from the breeding together by the hand of man of two different plants of the same or substantially similar species, a first plant comprising said first recombinant nucleic acid molecule expressing said first FFPP and a second plant comprising said second recombinant nucleic acid molecule expressing said second FFPP;

(b) said plant or seed are produced from the regeneration of a plant from the transformation of a first plant cell by said first recombinant nucleic acid molecule and the transformation of a second plant cell by said second recombinant nucleic acid molecule;

(c) said plant or seed are produced from the transformation of a single plant cell by said first and said second recombinant nucleic acid molecule; and (d) said plant or seed are grown from a plant or seed of any of (a), (b), or (c), wherein said plant or seed comprise said first and said second recombinant nucleic acid molecule.

The invention provides for compositions comprising a first polypeptide and a second polypeptide that is different from the first polypeptide, wherein said first and second polypeptides are each toxic to a target pest and do not bind to the same target receptor in said pest, and wherein said first and second polypeptide are selected for use together by the steps as set forth in any of the above embodiments.

The invention also provides for methods for, optionally: assessing, selecting, determining the utility of using, determining that: at least two different toxins, pesticidal polypeptides, or pesticidal proteins: are compatible for use together to control a target pest, or, at least two different pesticidal proteins, toxins, or pesticidal polypeptides are compatible for use together in a single composition, in a plant, or in a mixture, to control a target pest, wherein said method comprises:
(a) Providing a first pesticidal protein and a second pesticidal protein different from the first pesticidal protein, wherein each pesticidal protein is pesticidal when provided alone upon ingestion to said target pest, and is fully functional in causing morbidity and/or mortality to said target pest;
(b) disabling by modifying/altering/ or disrupting the toxic/pore forming feature of, or inactivating said second pesticidal protein so that upon ingestion by said target pest, said disabled second pesticidal protein is unable to cause morbidity and/or mortality and does not exhibit toxicity to said target pest (toxins' ability (toxic properties toward said target pest) to cause any toxic affect upon said target pest is diminished/significantly diminished or reduced/eliminated) without (diminishing/reducing/affecting/eliminating) said disabled second toxins' capacity to bind (ability to bind/affinity for binding) a particular receptor in the gut of said target pest to which said second toxin normally binds (said second toxin normally has affinity);
(c) providing in the diet of said target pest a sufficient amount of said disabled second toxin to bind (mask/block/reduce/eliminate) the particular receptor in the gut of said target pest to which said second toxin (said disabled second toxin) normally binds (has affinity to);
(d) providing in the diet of said target pest to which said sufficient amount of said disabled second toxin has been provided (of step (c)), an amount (a pesticidally effective amount) of said first toxin (that is known from step (a)) sufficient to elicit a toxic effect upon said target pest; and
(e) Observing the effects of said first toxin upon said target pest in the presence of said disabled second toxin;
wherein an observation from step (c) that said first toxin exhibits a toxic effect is determinative that said first toxin and said second toxin are compatible for use together.

The invention also provides for a method for assessing the contribution of a toxin protein to the overall efficacy of a composition containing two or more toxins which are different from each other and are each toxic to the same target insect pest, comprising the steps of:
(a) Providing a first toxin and a second toxin different from the first, wherein each toxin is toxic upon ingestion (in the absence of the other toxin) to said target pest (is fully functional in causing morbidity and/or mortality to said target pest);
(b) disabling (modifying/altering/disrupting the toxin feature of/inactivating) said second toxin so that upon ingestion by said target pest, said disabled (altered/modified/disrupted/inactivated) second toxin fails to cause morbidity and/or mortality (does not exhibit toxicity to said target pest/toxins' ability (toxic properties toward said target pest) to cause any toxic affect upon said target pest is diminished/significantly diminished or reduced/eliminated) without diminishing (reducing/affecting/eliminating) said disabled second toxins' capacity to bind (ability to bind/affinity for binding) a particular receptor in the gut of said target pest to which said second toxin normally binds (said second toxin normally has affinity);
(c) providing in the diet of said target pest a sufficient amount of disabled second toxin to bind (mask/block/reduce/eliminate) the particular receptor in the gut of said target pest to which said second toxin (said disabled second toxin) normally binds (have affinity to);
(d) providing in the diet of said target pest to which said sufficient amount of said disabled second toxin has been provided (of step (c)), an amount (a pesticidally effective amount) of said first toxin (that is known from step (a)) sufficient to elicit a toxic effect upon said target pest; and
(e) Observing the effects of said first toxin upon said target pest in the presence of said disabled second toxin; wherein an observation from step (e) that said first toxin exhibits a toxic effect is determinative that said first toxin and said second toxin are compatible for use together in a pesticidal composition, expressed in, or applied to a plant for:
(1) Controlling said target pest;
(2) Protecting said plant from infestation by said target pest; or
(3) decreasing the likelihood of the development of resistance by said target pest to either the first toxin or the second toxin
(4) for the purpose of aiding in or improving resistance management practices for controlling said particular target pest; or
(5) in a composition or in a plant for the purpose of delaying the onset of resistance to any of the compatible toxins.

Any of the methods above are contemplated to provide for a first toxin or pestidical protein having a naturally occurring receptor binding motif and a second toxin or pesticidal protein is a naturally occurring protein or is an engineered insecticidal protein (chimera, modified (insertion, deletion, substitution of one or more amino acids)) engineered using any number of methods including (i) site directed modification of a gene encoding such protein to cause the insertion, deletion or substitution of one or more amino acids, (ii) directed evolution methods of Maxygen, Verdia, or those in which phage, in particular filamentous bacteriophage, are used, and (iii) random mutagenesis and selection of a functional toxin protein.

The invention also provides for a plant comprising a combination of two or more different toxin/pesticidal proteins each toxic to the same target pest, wherein said toxin/pesticidal proteins have been selected for use in such plant using steps as set forth in any of the preceding embodiments, and for a composition for use in controlling a target pest, wherein said composition comprises at least two different toxin/pesticidal proteins selected for use in such composition using the steps as set forth in any of the preceding embodiments.

The invention provides for seed of a plant, wherein the genome of said seed comprises a first transgene encoding a first toxin/ pesticidal protein and a second transgene encoding a second toxin/pesticidal protein, wherein either toxin/pesticidal protein alone is effective in controlling the same target pest, wherein the two toxins/pesticidal proteins have been selected for use together in the same plant using any of the steps as set forth in any of the preceding embodiments, and the plants that are contemplated are further selected from the group consisting of a monocot and a dicot; wherein said monocot is further selected from the group consisting of corn, wheat, rice, and millets, and wherein said dicot is further selected from the group consisting of soybean, cotton, sunflower, alfalfa, canola, pigeon pea, tomato, pepper, gourd, melon, apple, pear, fig, orange, grapefruit, lemon, lime, and perennial flowers.

The invention provides for a method for selecting two or more toxin proteins (each being different from the other by at least one amino acid, and each being toxic to the same target pest) that are compatible with each other and which can be used collectively and optionally:

(a) in a composition or in a plant for controlling said target pest;
(b) for diminishing the likelihood of the development of resistance to any of the compatible toxin proteins;
(c) in a pesticidally effective/agriculturally acceptable composition produced in or applied, alone or separately, to a plant;
(d) in a plant or in a composition for the purposes of protecting a plant from infestation by said target pest;
(e) in a composition or in a plant for the purpose of decreasing the likelihood of the development of resistance by said target pest to any of the compatible toxin proteins;
(f) in a composition or in a plant for the purpose of aiding in or improving resistance management practices for controlling said target pest;
(g) in a composition or in a plant for the purpose of delaying the onset of resistance to any of the compatible toxins; and
(h) in other unique applications for pest management.

In particular, the design, production and useful applications for such compatible protein toxins are provided, as well as compositions and methods for the same. The method also provides for selecting toxins toxic to the same pest for use together in a composition or in plants for protecting against the infestation of the pest, and to reduce the likelihood of development of resistance of the pest to either of the selected toxins used together in the composition or in the plant.

A method of preparing a disabled polypeptide (DP) from a first fully functional pesticidal polypeptide (first FFPP) is provided in which the pesticidal activity of the first FFPP on the target pest depends on the FFPP binding to a naturally occurring target pest receptor (TPR). The method comprises the steps of:

(a) First, introducing one or more modifications into a segment of the first FFPP to produce a DP; the one or more modifications are introduced at a location in the amino acid sequence of the first FFPP which results in the formation of a new amino acid segment sequence, the sequence of the resulting DP. The DP exhibits a toxic potency substantially less than the toxic potency of the first FFPP when the DP is provided separately in the diet of the target pest. The ability of the DP to bind to the naturally occurring TPR to which the first FFPP binds is unaffected; and
(b) Second, the first FFPP and the DP are then compared separately to confirm the reduction or absence of toxic potency of the DP to the target pest, and to evaluate the ability or extent to which the DP is able to reduce or eliminate the toxic potency of the first FFPP by first providing the DP in the diet of a plurality of the target pest and then provide samples containing the first FFPP at various concentrations or proportions to separate groups of the plurality of pests to which the DP has been provided;

And observing whether the DP, when used alone, exhibits a substantially diminished toxic potency compared to that of the first FFPP when provided in the diet of said target pest, and observing whether and the extent to which the DP, when used together with various molar ratios/concentrations of said first FFPP, is effective in titering the toxic potency of the first FFPP toward the target pest.

Disabled insecticidal protein toxin isoforms, capable of binding the appropriate receptor but incapable of inducing or conferring toxic effects, are derived from insecticidal protein toxins (parent toxins, fully functional isoform toxins), such that the disabled toxins retain the parent toxins ability to bind to a target insect receptor protein but are incapable of undergoing all further changes required to kill or stunt the target insect, i.e., incapable of inducing or conferring toxic effects. For example, Bt derived insect toxins, following ingestion, activation and binding to its cognate or natural receptor in the target insect gut, undergo structural changes to form oligomers which insert into the insect membrane, forming transmembrane pores that result in feeding cessation and death. The disabled insecticidal protein toxin's ability to compete with the parent toxin, or fully functional isoform toxin, at the insect protein binding site (the cognate or normal, natural receptor), without causing, conferring or conveying toxic effects (i.e., inhibiting stunting or mortality), provides a useful tool for discovering toxins which bind to different insect toxin receptor proteins and thereby exhibit a different mode of action, compared to the fully functional isoform toxin. Combining insect toxins which display different modes of action by binding to different toxin receptor proteins in the same insect species has proven useful in developing crops that survive insect infestation without allowing or encouraging toxin-resistance in the target insect species.

Methods for preparing disabled insecticidal proteins are provided herein. In one embodiment the disabled insecticidal protein toxin is prepared by introducing one or more changes in amino acids at one or more positions within the amino acid sequence of the fully functional parent or isoform toxin, at a location which results in reduced toxicity to the target insect without effecting disabled protein binding to the natural protein receptor in the target insect gut. In the case of a three-domain Cry toxin, the amino acid changes are in Domain I, which is believed to be the site of transmembrane pore formation. Domains II and III are not changed so that the insect receptor protein binding properties are retained in the disabled protein toxin. In another embodiment the disabled insecticidal protein toxin is derived from a β-pore-forming Bt insecticidal protein toxin. In this case, toxic pore formation is prevented by introducing changes in amino acids positioned in the amphipathic β-pore-forming loop or in an adjoining protein structure or in both.

In additional embodiments the disabled insecticidal protein toxin is prepared by introducing at least two cysteine mutations into regions of the insecticidal protein toxin involved in toxic pore formation, such as those described above. The cysteine mutations can be introduced as either replacement mutations, substituting for amino acids in the sequence of the fully functional toxin, or insertion mutations, adding to the sequence at positions between two existing amino acids, with the proviso that these at least two cysteine residues are located 8 to 10 angstroms apart. Subsequently reacting the mutated protein with a bifunctional sulthydryl crosslinking reagent, such as iodoacetamide derivative N,N'-ethylene bis (iodoacetamide), maleimide derivative bis (maleimido) ethane or the like, results in a derivative of the fully functional toxin which retains the ability to bind to the natural or normal target toxin receptor without producing a toxic effect on the target insect.

In another embodiment the disabled proteins are screened for activity in a diet bioassay against the target insect. First, it is established that the disabled protein demonstrates a lack of toxicity in the target insect by comparing results from two separate diet bioassays, one using the disabled protein toxin isoform, and the other using the fully functional isoform toxin, both at equivalent concentrations that produce a toxic effect when using the fully functional toxin, and no toxic effect when using the disabled protein isoform. Second, the ability of the disabled protein toxin to retain toxin receptor protein binding is demonstrated in a diet bioassay against the target insect. Administration of various molar ratios of the disabled protein and the fully functional isoform toxin are mixed together in the insect diet. Results exhibit a decrease in target insect toxicity for the fully functional protein toxin where the molar concentration of the disabled protein is equal to or greater than the molar concentration of the fully functional toxin.

Isolated disabled protein toxins are provided, derived from fully functional isoform toxins, with one or more amino acid modifications, including substitutions, insertions and deletions, in a protein domain of the fully functional isoform toxin, at a location which results in reduced toxicity to the target insect without effecting target insect receptor protein binding when compared to the original, fully functional isoform toxin. Disabled insecticidal protein toxins disclosed herein include those set forth in SEQ ID NOs:4 and 6, encoded by nucleotide sequences set forth in SEQ ID NOs:3 and 5, respectively.

In another embodiment, isolated disabled protein toxins are provided, derived from fully functional isoform protein toxins, with at least two cysteine amino acid substitutions located 8 to 10 angstroms apart in a protein domain of the fully functional isoform toxin, which is rendered disabled following exposure to a bifunctional sulfhydryl crosslinking reagent, such as iodoacetamide derivative N,N'-ethylene bis (iodoacetamide), maleimide derivative bis (maleimido) ethane or the like, resulting in a derived variant of the fully functional isoform toxin which retains the ability to bind to the normal target insect toxin receptor without causing any toxic effect on the target insect. Disabled insecticidal protein toxins disclosed herein include those set forth in SEQ ID NOs:8, 12, 16, 22, 24, 26 and 28, encoded by nucleotide sequences set forth in SEQ ID NOs:7, 11, 15, 21, 23, 25 and 27, respectively.

Also provided herein is a method of assessing the mode of action for any particular insecticidal protein toxin against a target insect by comparing the modes of action of a plurality of different insecticidal protein toxins in the target insect, wherein the mode of action is distinguished by the binding of an individual fully functional insecticidal protein toxin to a specific target insect receptor protein. Thus, toxins shown to bind to the same insect receptor protein share the same mode action, while toxins that bind to different insect receptor proteins display different modes of action. The assessment is carried out as follows: (a) prepare a disabled protein toxin, as described above, for a particular fully functional protein toxin; (b) evaluate the toxicity of the particular fully functional protein toxin against the target insect, in the absence and in the presence of a molar excess of the disabled protein toxin isoform; and (c) compare the resulting target insect susceptibility to protein toxin effects to assess the mode of action for the particular protein toxin, wherein the mode of action for the protein toxin is the same as the fully functional isoform toxin of any disabled protein toxin which suppresses or impairs the toxic activity of the particular protein toxin. Disabled insecticidal protein toxins disclosed herein include those set forth in SEQ ID NOs: 4, 6, 8, 12, 16, 22, 24, 26 and 28.

In another embodiment, fully functional protein toxins are provided whose toxicities are partially or fully suppressed or impaired in the presence of a polypeptide comprising an amino acid sequence having about 44%-100%, including 44%, or 50%, or 55%, or 60%, or 65%, or 70%, or 75%, or 80%, or 85%, or 90%, or 95%, or 99%, or 100%, amino acid sequence identity to the amino acid sequence of any of SEQ ID NOs:4, 6, 8, 12, 16, 22, 24, 26 and 28. In another embodiment these insecticidal protein toxins, identified as described above, provide a method for controlling insect pest infestation by contacting the insect pest with an insect inhibitory amount of these insecticidal protein toxins, which are especially useful in controlling pest infestations by Coleoptera, Diptera, Hymenoptera, Hemiptera and Lepidoptera. In another embodiment these insecticidal protein toxins, identified as described above, can be expressed in a plant or a seed from a plant, providing protection from insect infestation by incorporating a recombinant nucleic acid molecule comprising a heterologous promoter operably linked to a polynucleotide segment encoding one of these identified insecticidal protein toxins.

In another embodiment is a method for selecting two pesticidal agents compatible for use together in a composition for controlling a target pest, said method comprising the first step of selecting a first and a second toxic agent, each agent being different from the other and each agent causing toxic properties when provided individually in the diet of a target pest. A second step includes producing a DT from said first toxic agent that, upon ingestion by said target pest, blocks the toxic properties conferred by said first toxic agent but does not itself confer toxic properties. The third step in the method provides for producing a plurality of different mixtures containing a fixed but pesticidally effective amount of a second toxic agent, and increasing amounts of said DT. The next step provides in the diet of said target pest, a pesticidally effective amount of said second toxic agent, then providing a dose of each mixture of the third step separately to each of at least three different individuals of said target pest. The target pests having received the various samples or doses of toxic agent or of toxic agent mixtures is then observed for evidence of any toxic properties in any of the individual target pests that have received the various doses, and any such observation of such toxic properties is determinative that said first and second toxic agents are compatible for use together to control the said target pest.

The method can further include a recombinant plant or seed expressing two or more pesticidal agents, wherein the said agents are selected for use together as compatible agents.

The invention includes embodiments such as a method for selecting a first FFPP and a second FFPP to be combined together in a composition or for use on or in a plant to control insect infestation of said plant by a target insect pest species, wherein said combination of said FFPP's optionally provide:
(a) for decreasing the likelihood of the development of resistance by said target insect pest to any of the FFPP's in said composition;
(b) for aiding in or improving resistance management practices for controlling said target insect pest; or
(c) for delaying the onset of resistance to any of the FFPP's in said composition.

The method provides for the said two or more FFPP's to be selected for use together, and the DP, when used in a plurality of molar ratios with a constant amount of said first FFPP, is effective in titering the toxic effect of the first FFPP upon said target pest. The said DP, when used in a plurality of molar ratios with a constant amount of said second FFPP, does not titer the toxic effect of the second FFPP upon said target pest. In such case, the said first and said second FFPP are compatible for use together in said composition on or in said plant.

Another method of the invention provides for assessing the mode of action of a first FFPP for compatibility with a second FFPP to be used in a common pesticidal composition, said method comprising the steps of first preparing a DP from a first FFPP that is toxic to a target pest, then confirming that said DP when used alone in a bioassay with said target pest has diminished toxicity against the target pest when compared to the toxicity of the first FFPP, and finally comparing said DP to a second FFPP different from said first FFPP, the second FFPP alone or the first FFPP alone but in each case along with a variable amount of said DP, i.e., for each FFPP/DP combination, in a plurality of molar ratios in which the DP is present in a greater concentration than said second FFPP in the diet of the target pest. Observing in the last step the inability of the DP present in any amount in a combination with the second FFPP to titer (to reduce, to inhibit, or to suppress) the toxic properties of said second FFPP with said DP is determinative of the binding of said first FFPP and said second FFPP to different receptors in said target pest, and therefore a functional assessment of the mode of action of a first FFPP for compatibility with a second FFPP to be used in a common pesticidal composition.

Additionally, the methods may be further defined as a composition comprising said first FFPP and said second FFPP, the composition being effective in controlling an insect pest infestation wherein said insects are selected from the group consisting of Arachnida, Coleoptera, Ctenocephalides, Diptera, Hemiptera, Heteroptera, Homoptera, Hymenoptera, Lepidoptera and Thysanoptera insects. The method may be further defined as a composition comprising said first toxic agent and said second toxic agent, the composition being effective in controlling an insect pest infestation wherein said insects are selected from the group consisting of Arachnida, Coleoptera, Ctenocephalides, Diptera, Hemiptera, Heteroptera, Homoptera, Hymenoptera, Lepidoptera and Thysanoptera insects.

The invention further contemplates a plant or a seed from a plant comprising a first recombinant nucleic acid molecule comprising a first heterologous promoter operably linked to a first polynucleotide segment encoding a first FFPP and a second recombinant nucleic acid molecule comprising a second heterologous promoter operably linked to a second polynucleotide segment encoding a second FFPP different from said first FFPP, wherein said first FFPP and said second FFPP are selected for use together from the steps of any of the foregoing methods. Optionally, the said plant or said seed are produced from the breeding together by the hand of man of two different plants of the same or substantially similar species. A first plant may comprise said first recombinant nucleic acid molecule expressing said first FFPP and a second plant may comprise said second recombinant nucleic acid molecule expressing said second FFPP. The said plant or seed are produced from the regeneration of a plant from the transformation of a first plant cell by said first recombinant nucleic acid molecule and the transformation of a second plant cell by said second recombinant nucleic acid molecule (or by transformation of a single cell by both recombinant molecules, whether operably linked together or whether each molecule is separate from the other), and the said plant or seed are grown from a plant or seed of any of the steps above in this paragraph, wherein said plant or seed comprise said first and said second recombinant nucleic acid molecule.

Compositions are contemplated which may comprise a first polypeptide and a second polypeptide that are each different from each other, and said first and second polypeptides are each toxic to a target pest and do not bind to the same target receptor in said pest, and wherein said first and second polypeptide are selected for use together by the steps of, first, producing a DT from said first polypeptide that, upon ingestion by said target pest, blocks the toxic properties conferred by said first polypeptide but does not itself confer toxic properties; second, producing a plurality of different mixtures containing a fixed but pesticidally effective amount of said second polypeptide, and increasing amounts of said DT; third, providing in the diet of said target pest, a pesticidally effective amount of said second polypeptide; fourth, providing a dose of each mixture of the third step separately to each of at least three different individuals of said target pest; and then last, observing toxic properties in any individual in the fourth step. An observation of toxic properties of the second polypeptide in such pest would be determinative that said first and second polypeptides are compatible for use together to control said target pest.

Other embodiments, features, and advantages of the invention will be apparent from the following detailed description, the examples and the claims.

BRIEF DESCRIPTION OF THE SEQUENCES

SEQ TD NO:1 is a nucleotide sequence encoding a Cry1Ab3 protein.

SEQ ID NO:2 is an amino acid sequence of a Cry1Ab3 protein.

SEQ ID NO:3 is a nucleotide sequence encoding a disabled Cry1Ab protein.

SEQ ID NO:4 is an amino acid sequence of a disabled variant Cry1Ab3_2 protein.

SEQ ID NO:5 is a nucleotide sequence encoding a disabled variant Cry1Ab3_3 protein.

SEQ ID NO:6 is an amino acid sequence of a disabled variant Cry1Ab3_3 protein.

SEQ ID NO:7 is a nucleotide sequence encoding a disabled variant Cry1Ab3_4 protein.

SEQ ID NO:8 is an amino acid sequence of a disabled variant Cry1Ab3_4 protein.

SEQ ID NO:9 is a nucleotide sequence encoding a TIC105 protein.

SEQ ID NO:10 is an amino acid sequence of a TIC105 protein.

SEQ ID NO:11 is a nucleotide sequence encoding a disabled variant TIC105_3 protein.

SEQ ID NO:12 is an amino acid sequence of a disabled variant TIC105_3 protein.

SEQ ID NO:13 is a nucleotide sequence encoding a TTC107 protein.

SEQ ID NO:14 is an amino acid sequence of a TIC107 protein.

SEQ ID NO:15 is a nucleotide sequence encoding a disabled variant TIC107_4 protein.

SEQ ID NO:16 is an amino acid sequence of a disabled variant T1C107_4 protein.

SEQ ID NO:17 is a nucleotide sequence encoding a Cry2Ab2 protein.

SEQ ID NO:18 is an amino acid sequence of a Cry2Ab2 protein.

SEQ ID NO:19 is a nucleotide sequence encoding a TIC834_16 protein.

SEQ ID NO:20 is an amino acid sequence of a TIC834_16 protein.

SEQ ID NO:21 is a nucleotide sequence encoding a disabled variant TTC834_18-1 protein.

SEQ ID NO:22 is an amino acid sequence of a disabled variant TIC834_18-1 protein.

SEQ ID NO:23 is a nucleotide sequence encoding a disabled variant TIC834_21-1 protein.

SEQ ID NO:24 is an amino acid sequence of a disabled variant TIC834_21-1 protein.

SEQ ID NO:25 is a nucleotide sequence encoding a disabled variant TIC834_22-1 protein.

SEQ ID NO:26 is an amino acid sequence of a disabled variant TIC834_22-1 protein.

SEQ ID NO:27 is a nucleotide sequence encoding a disabled variant TIC834_23-1 protein.

SEQ ID NO:28 is an amino acid sequence of a disabled variant TIC834_23-1 protein.

SEQ ID NO:29 is a nucleotide sequence encoding a disabled variant Cry2Ab2_6 protein.

SEQ ID NO:30 is an amino acid sequence of a disabled variant Cry2Ab2_6 protein.

SEQ ID NO:31 is a nucleotide sequence encoding a TIC834_14 _FFPP-2 protein.

SEQ ID NO:32 is an amino acid sequence of a TIC834 14 βFFPP-2 protein.

SEQ ID NO:33 is an artificial nucleotide sequence encoding a BCW003 toxin protein.

SEQ ID NO:34 is an amino acid sequence of a BCW003 toxin protein.

SEQ ID NO:35 is an artificial nucleotide sequence encoding a disabled variant BCW003 referred to as DT11.

SEQ ID NO:36 is an amino acid sequence of a disabled variant BCW003 protein DT11.

SEQ ID NO:37 is a nucleotide sequence encoding a Cry1Ca toxin protein.

SEQ ID NO:38 is an amino acid sequence of a Cry1Ca toxin protein.

SEQ ID NO:39 is a nucleotide sequence encoding a disabled variant of Cry1Ca, referred to as DT12.

SEQ ID NO:40 is an amino acid sequence of a disabled toxin Cry1Ca referred to as DT12.

SEQ ID NO:41 is a nucleotide sequence encoding a TIC844 toxin protein.

SEQ ID NO:42 is an amino acid sequence of a TIC844 toxin protein.

SEQ ID NO:43 is a nucleotide sequence encoding a disabled TIC844 toxin protein referred to as DT13.

SEQ ID NO:44 is an amino acid sequence of a disabled toxin TIC844 referred to as DT13.

SEQ ID NO:45 is a nucleotide sequence encoding a TIC868 toxin protein.

SEQ ID NO:46 is an amino acid sequence of a TIC868 toxin protein.

SEQ ID NO:47 is a nucleotide sequence encoding a disabled TIC868 toxin protein referred to as DT14.

SEQ ID NO:48 is an amino acid sequence of a disabled TIC842 protein referred to as DT14.

SEQ ID NO:49 is a nucleotide sequence encoding a TIC842 toxin protein.

SEQ ID NO:50 is an amino acid sequence of a TIC842 toxin protein.

SEQ ID NO:51 is a nucleotide sequence of a disabled TIC842 toxin protein referred to as DT15.

SEQ ID NO:52 is an amino acid sequence of a disabled TIC868 protein referred to as DT15.

SEQ ID NO:53 is a nucleotide sequence encoding a VIP3A toxin protein.

SEQ ID NO:54 is an amino acid sequence of a VIP3A toxin protein.

SEQ ID NO:55 is a nucleotide sequence encoding a disabled VIP3A toxin protein referred to as DT16.

SEQ ID NO:56 is an amino acid sequence of a disabled VIP3A protein referred to as DT16.

SEQ ID NO:57 is a nucleotide sequence encoding a TIC1100 toxin protein.

SEQ ID NO:58 is an amino acid sequence of a TIC1100 toxin protein.

SEQ ID NO:59 is a nucleotide sequence of a disabled TIC1100 toxin protein referred to as DT17.

SEQ ID NO:60 is an amino acid sequence of a disabled TIC1100 referred to as DT17.

SEQ ID NO:61 is a nucleotide sequence encoding a TIC867 toxin protein.

SEQ ID NO:62 is an amino acid sequence of a TIC867 toxin protein.

SEQ ID NO:5635 is a nucleotide sequence of a disabled TIC867 toxin protein referred to as DT18.

SEQ ID NO:64 is an amino acid sequence of a disabled TIC867 referred to as DT18.

DETAILED DESCRIPTION OF THE INVENTION

One of the most challenging problems facing researchers in the field of insecticidal toxin discovery and development involves the identification of new modes of action (MOA) for insect resistance management. Alterations in receptor binding sites are believed to play a significant role in the development of toxin resistance by insects in the field. Methods that distinguish differences in receptor binding include ligand blotting and competitive binding assays, using isolated insect brush border membranes (BBMs). These methods require significant development work to optimize both toxin- and BBM-preparation and to validate these assays across multiple insect species. The methods described in this disclosure rely on the use of disabled insecticidal proteins or disabled toxins that retain insect receptor binding activity but are unable to produce a toxic or lethal effect in the target insect. Such disabled insecticidal proteins are able to compete with homologous native toxins in insect bioassays, resulting in suppression of insecticidal activity by reducing or preventing the native or parent toxin from binding to a cognate insect receptor, required to produce a lethal effect on the target insect species. When combined with heterologous insect toxins that don't share a common MOA, such as by not binding to the same receptor as the disabled insecticidal protein, these disabled insecticidal proteins should not exhibit competitive inhibition in insect bioassays. The outcome of these competitive assays is unambiguous and requires only a functional insect bioassay including the cognate insect receptor which binds the parent toxin. This method thus provides a facile procedure for researchers to arrange Cry proteins or other insecticidal toxins into groups that are likely to share receptor binding sites. While this data alone doesn't provide conclusive evidence that two toxins share receptor binding sites, it does allow researchers to prioritize those toxins that appear to operate through different modes-of-action based upon the absence of competition in an insect bioassay that includes a disabled insecticidal protein. In addition, since the method only requires a valid insect bioassay, it is easier to assess competition across a wide range of insect target species.

Unless otherwise noted, terms are to be understood according to conventional usage by those of ordinary skill in the relevant art.

As used herein a "disabled pesticidal protein" or "disabled toxin" is a protein, derived from an insect toxin, such as a Bt protein toxin, which retains the capability of insect receptor binding without producing a lethal effect on the target insect.

The terms "active" or "activity"; "pesticidal activity" or "pesticidal"; "entomocide" or "entomocidal"; "nematicide" or "nematicidal"; "fungicide" or fungicidal"; "insecticidal activity", "insect inhibitory", "insecticidal", or "an insect inhibitory amount", refer to efficacy of a toxic agent, such as an insecticidal protein, in inhibiting (inhibiting growth, feeding, fecundity, or viability), suppressing (suppressing growth, feeding, fecundity, or viability), controlling (controlling the pest infestation, controlling the pest feeding activities on a particular crop containing an effective amount of a disclosed insecticidal or pesticidal protein) or killing (causing the morbidity, mortality, or reduced fecundity of) an applicable target pest.

Reference to a pest, particularly a pest of a crop plant, means, for example, nematode, fungal or insect pests and the like of crop plants, particularly any embryonic, larval, nymph or adult form of an Arachnid, Coleopteran, C tenocephalides, Dipteran, Hemip teran, Heterop teran, Homopteran, Hymenopteran, Lepidopteran or Thysanopteran insect. The term "target pest" refers to a particular pest species for which a pesticidal protein is selectively toxic.

As used herein, a "transgenic plant", "transgenic plant event" or "transgenic crop" is any plant in which one or more, of the cells of the plant include a transgene. A transgene may be integrated within a nuclear genome or organelle genome, or it may be extra-chromosomally replicating DNA. The term "transgene" means a nucleic acid that is partly or entirely heterologous or foreign to a plant or cell into which it is introduced.

Reference to "resistance", as in "insect resistance" or "pest resistance", refers to the development of one or more mechanisms in an insect, nematode or fungal pest to overcome or nullify the lethal effects of a pest toxin. For protein toxins, such as Bt toxins, that may require binding to an insect receptor protein to initiate a lethal event, resistance may develop when there is a change in the toxins amino acid sequence, for example as caused by a mutation, such as an amino acid substitution, insertion or deletion in the target insect toxin receptor protein, preventing or inhibiting the toxin from binding to the target insect receptor protein.

The term "parent toxin", "native toxin", "wild-type toxin", "fully functional toxin" or "fully functional isoform toxin" refers to the pesticidal protein toxin from which a disabled pesticidal protein is derived. Design and production of the disabled insecticidal or pesticidal protein depends on the particular structure of the parent or fully functional isoform toxin using methods, including but not limited to introducing changes in the amino acid sequence, through insertion, deletion or substitution at one or more positions in the sequence of the fully functional isoform toxin, in order to render the disabled toxin non-lethal, while retaining the capability to bind to the natural pest receptor protein to which the fully functional toxin binds to initiate lethal activity. In addition, chemical crosslinks may be introduced at susceptible sites in the toxin sequence, such as bifunctional sulfhydryl crosslinks between two cysteine residues (existing or introduced by mutation), impeding protein chain mobility that might be required for the occurrence of an effective toxin-receptor protein binding event.

As used herein, the term "individual testing" refers to an assay, usually an insect diet bioassay, where a pesticidal protein toxin or a disabled protein toxin is tested for pesticidal activity by itself, with no other test compounds included. The term "combination testing", refers to compounds in a similar assay but where more than one compound is present in the test medium or diet, in a combined mixture, as when an pesticidal protein toxin is tested in the presence of a molar excess of a disabled protein toxin, to determine if the tested pesticidal protein toxin binds to the same pest receptor protein (or has the same mode of action) as the fully functional isoform toxin from which the disabled toxin was derived.

The term "three-domain toxins" typically refers to the core toxin, following proteolytic removal of a protoxin segment from parasporal crystalline or Cry proteins produced by *B. thuringiensis*. These core toxins display folding patterns that typically comprise three distinct structural domains. The Domain I segment, can usually undergo various structural changes, following toxin binding to an insect protein, in order to form a pore which permeates insect cells. The Domain II and Domain III segments are usually involved in the recognition and binding of the toxin to one or more insect protein receptors, which can initiate various structural changes in the Domain I segment. Subsequent oligomerization of the Domain 1 segment results in formation of multimeric ion conducting pores which permeate insect cells, causing lysis and eventually death. Examples of core Cry toxins with established three-domain crystal structures include Cry1Aa1, Cry2Aa1, Cry3 Aa1, Cry3Bb1, Cry4Aa, Cry4B a and Cry8Ea1 (deMaagd, et al, (2003) Annu. Rev. Genet. 37: 409-433).

The term "β-pore-forming toxin" refers to an insecticidal protein of the *Clostridium epsilon* toxin ETX/*Bacillus* mosquitocidal toxin MTX2 (ETX_MTX2) family, PF03318, related to the aerolysin protein family, PF01117. The ETX_MTX2 protein toxins contain amphipathic β-hairpin loops which, upon activation, are predicted to form a complex β-barrel structure that is capable of inserting into the insect gut cell membrane and cause mortality.

Reference to pesticidal or insecticidal protein toxin activities which are "suppressed partially or fully" in the presence of a compatible disabled protein toxin, means that the pesticidal or insecticidal toxin activity, measured in vitro or in vivo, is reduced in the presence of a compatible disabled protein toxin by 20% to 100%, including 20%, or 30%, or 40%, or 50%, or 60%, or 70%, or 80%, or 90%, or 100%.

As used herein, the term "cognate receptor" or "normal receptor" or "natural receptor" means any receptor, in or on or expressed by a target pest or insect to which a pesticidal or insecticidal protein toxin binds in order to function as an insecticide or pesticide.

Disabled protein toxins are considered to be "compatible" with pesticidal or insecticidal protein toxins when both toxins (disabled and fully-functional pesticidal) bind to the same receptor, expressed by one or more target pests. Thus, when a disabled protein toxin binds to a target pest receptor, any compatible pesticidal or insecticidal protein toxin will be blocked from binding to or occupying the same receptor, resulting in suppression or reduction in the toxic efficacy of the protein toxin on that target pest or any target pest expressing a receptor to which the compatible disabled protein toxin binds.

The novel methods described herein rely on modifying the amino acid sequence of a first pesticidal protein toxin (referred to herein interchangeably as a fully functional polypeptide, i.e. an "FFPP", or as a fully functional toxin, i.e. a "FFT" or the parental or native toxin) that is toxic to a target pest, resulting in a disabled protein or disabled toxin (referred to interchangeably herein as a DP (disabled protein), a DT (disabled toxin), or as a DIP (a disabled insecticidal protein)), a protein that no longer exhibits the ability to cause morbidity or mortality to the target pest in the same way as the FFPP, yet the modified protein, the DT, retains the FFPP's receptor binding activity in the target pest. Effectively, the capacity or ability of the protein to exhibit a toxic effect, or to cause morbidity or mortality, has been restricted. By restricted, it is also intended that the terms eliminated, disabled, inactivated, inhibited, and/or removed be used interchangeably. Such DP's thus are intended to lack the toxic effects when ingested by the target pest species that are associated with the DP's cognate toxin protein from which it has been derived. Thus, a FFT from which a DP may be constructed retains the full natural ability to bind to a receptor in a target pest, and to cause morbidity or mortality in the target pest, yet the disabled form of the protein, for the purposes of the invention described herein, will be inhibited or altered with respect to these functions, i.e. the disabled protein will no longer be able to bind to a receptor in the target pest and will no longer be able to cause morbidity or mortality in the target pest. By use of the term "bind to", it is intended that the terms "affinity", "capacity", "activation", "structural transition", "aggregation", "oligomerization", and "pore formation" be used interchangeably.

Herskowitz (Nature 329:219-222 (1987)) introduced the dominant negative concept and defined that "a dominant negative mutant protein will retain an intact, functional subset of the domains of the parent, wild-type protein, but have the complement of this subset either missing or altered so as to be non-functional". Interactions between functional and dysfunctional proteins can be the result of (i) differential rates of activation of one versus the other, (ii) competition between the two for a common receptor, (iii) disruption of oligomerization into a structure that is no longer capable of forming functional pores, and (iv) failure to properly form pores across the membrane with which the proteins have interacted. Given that three-domain Cry proteins form oligomers, an inactive variant capable of interacting with the parent protein will be inhibitory as it causes the formation of non-functional oligomers. Rodríguez-Almazán et al. (PloS ONE 4(5):e5545) reported that the Cry1Ab[E129K/D136N] variant acted as a "dominant negative" variant, inhibiting Cry1Ab activity towards *Manduca sexta* (tobacco hornworm) via oligomerization with native Cry1Ab monomers, resulting in a loss of ion channel or pore-forming activity of the mixed oligomer. Herskowitz also indicated that a monomeric protein deficient in oligomerization can also be inhibitory if there is limiting amount of substrate. Bt receptors, which are key in conferring the spectrum of insecticidal activity to three-domain Cry proteins, are displayed on the midgut epithelium and are generally less abundant than the insecticidal proteins used. Herskowitz as well as Rodríguez-Almazán et al. disclosed the features of homologous inhibition, in which a monomeric DT variant that is deficient in self-oligomerization, but which otherwise has unaltered receptor binding domain(s), would compete against its native counterpart on a target insect if it is mixed with the FFPP in large excess. No prior art has disclosed that a DT variant, when mixed with a heterologous insecticidal protein FFPP that shares receptor(s) with the DT, would reduce the insecticidal activity in a dose dependent manner due to the ensuing receptor competition between FFPP and DT proteins, nor did the prior art recognize that the absence of inhibition of a heterologous toxin by such a DT means that the toxin from which the DT was derived is compatible for use in a composition with the heterologous toxin for controlling the target pest to which both toxins are toxic, i.e., neither of the two toxins are binding a common receptor, therefore both are compatible with each other for use in a toxin composition for targeting a single target pest for control. Methods described here rely on the use of insecticidal proteins with amino acid substitutions in parts of the protein other than those that are engaged in receptor binding, resulting in the insecticidal protein becoming inactive, presumably due to impairment of ion channel activity, which could be a result of any of the steps (i), (iii), or (iv) above. The DT's exemplified in this application suppressed in vivo the insecticidal activity of the respective FFPP from which the DT was derived in a concentration-dependent manner, presumably because the DT retains the independent receptor binding specificity associated with the cognate FFPP.

The methods described herein, and the resulting combinations of pesticidal proteins described herein, are designed to be more effective and efficient than the methods provided in the prior art for distinguishing compatible toxins for use in a single composition or in a single plant, i.e. for selecting combinations of toxin proteins that can be used together to control a single target pest using at least two different independent modes of action. The method provides for a certain toxin protein (a fully functional toxin "FFPP") to be modified in a way that inactivates or disables the toxic properties of the protein, i.e. the ability of the modified protein toxin to induce any toxic effects (morbidity or mortality) has been eliminated or substantially reduced compared to the FFPP (each a disabled toxin or "DP"), yet the modified toxin protein (the DP) continues to be fully capable and able to successfully compete with a fully functional isoform toxin (i.e. the "FFPP") from which the DP has been derived. The DP and the FFPP with which the DP competes will inhibit the binding to and block a natural target receptor binding site, provided that the FFPP and the DP each recognize that receptor as a natural receptor in the target pest being evaluated, or may inhibit activation, structural transition, aggregation, oligomerization, and/or pore formation, collectively referred to herein as the steps leading to pesticidal activity. By reference to "pesticidal activity", it is intended that this be used interchangeably with the terms "toxicity" or "toxic properties". Without intending to be bound by any one theory, it is believed that when tested in a pest bioassay, including an insect pest bioassay, a mixture containing the fully functional isoform toxin (fully functional pesticidal protein, i.e. FFPP) which has demonstrated morbidity or mortality when provided in the diet of the pest, will exhibit a diminished or eliminated morbidity or mortality when a sample containing a disabled proteins (DP) is also presented in the diet, particularly when the DP is present in a molar excess compared to the FFPP, effectively suppressing the pesticidal activity of the fully functional isoform toxin (FFPP), by competing for the same receptor within the target pest. Thus, disabled proteins, as described herein, provide a useful tool for distinguishing toxins that exhibit toxic effects against a common target pest that confer the toxins' activity by different or common modes of action. Toxins that act with the same or substantially same mode of action are quickly identified because a DP made from a first toxin (first FFPP) that binds to a first receptor that is recognized by a second toxin (second FFPP), i.e. the first FFPP and the second FFPP commonly recognize the first receptor in the same pest thus a DP made using the first toxin (first FFPP) would effectively compete with the ability of the second FFPP to bind and exert its toxic effects upon the pest. Therefore, the first and second toxins would not be compatible for use in a composition for controlling a target pest to which both the first and the second toxins are each effective in conferring morbidity or mortality upon said pest. Such toxins are incompatible with each other.

Disabled protein toxins are considered to be "incompatible" with fully-functional pesticidal or insecticidal protein toxins when they bind to different receptors in a target pest. Thus when both incompatible toxins (disabled and fully-functional pesticidal) contact a target pest, there is no suppression or reduction in the toxic efficacy of the protein toxin on the target pest.

An important strategy in overcoming the development of insect resistance to lethal transgenic protein toxins in crop plants, such as insecticidal Bt toxins and the like, is to provide one or more additional transgenic nucleotides in the plant, expressing insecticidal protein toxins that bind to target insect receptors that are different in comparison to insect receptors used by other transgenic protein toxins, which are simultaneously co-expressed in the same plant. In another embodiment disabled protein toxins can be used to identify fully-functional effective toxins that are incompatible or compatible with the disabled protein toxin. These results can be used to develop combinations of transgenic nucleotides encoding compatible protein toxins and incompatible toxins, to provide a transgenic plant that is lethal to target insects by using two or more modes of action, thus preventing or reducing the development of insect resistance through mutations in a single target pest receptor.

Designing a disabled insecticidal protein toxin includes, but is not limited to, identifying relevant residues to modify. For example, in the case of a three-domain Cry toxin, the preference would be to modify residues in Domain I, especially those associated with aggregation and/or membrane piercing pore formation. This step would be followed by cloning, expressing and testing the disabled protein to identify those possessing no toxic effects in the target insect, compared to the fully-functional parent protein toxin, and which, when combined with a compatible toxin at a molar excess in a diet bioassay, suppresses the toxic effects of the compatible toxin.

The elucidation of the atomic structure of compatible toxins can also be used to guide and complement approaches for selecting amino acid residues to modify for engineering of a disabled insecticidal protein toxin.

To generate variant proteins, an isolated nucleic acid molecule encoding a variant protein can be created by introducing one or more nucleotide substitutions, additions or deletions into the nucleotide sequence of any protein or peptide, such that one or more amino acid residue substitutions, additions or deletions are introduced into the encoded protein. Mutations can be introduced by standard techniques, such as site-directed mutagenesis and PCR-mediated mutagenesis.

The preparation of sequence variants of the disabled insecticidal protein toxin-encoding nucleic acid segments using site-directed mutagenesis is provided as a means of producing potentially useful disabled toxin species and is not meant to be limiting as there are other ways in which sequence variants of peptides and the DNA sequences encoding them may be obtained or constructed.

All known Bt insecticidal Cry toxins are proteolytically activated to form soluble globular proteins that bind to insect gut cell receptors then undergo oligomerization and conformational transition into complex transmembrane pore assemblies. Since this transformation involves a great deal of backbone rearrangement it is reasonable to expect that pore formation can be arrested by placing restraints on the mobility of certain structural elements. It has been reported that introducing disulfide bridges into Domain I of Cry1Aa resulted in an inactive toxin in the oxidized state, unable to form functional ion channels in planar lipid bilayers (Schwartz, et al. (1997) FEBS Letters 410, 397-402). While direct disulphide crosslinking may be feasible for in vitro experiments, the insect gut environment may provide enough reducing power to reduce S—S bonds and re-activate the inactive crosslinked toxin. In a number of the disabled insecticidal proteins described herein, mobile elements in parent toxins are chemically cross-linked by first introducing cysteine residues in proximal positions that are too far for direct disulphide formation but are close enough to be crosslinked with sulthydryl-reactive homo-bifunctional reagents. For example, irreversible crosslinks can be formed between cysteines with iodoacetamide containing reagents (e.g., N,N'-ethylene bis (iodoacetamide)) or maleimide containing reagents (e.g., bis (maleimido) ethane) or similar functional crosslinkers. Creation of disabled protein toxins using this method entails selection of two suitable residues (positioned ~8-10 Å apart), substituting them both with cysteine residues, expressing the resulting recombinant toxin and cross-linking the toxin with a bifunctional linking reagent as described above. This method is particularly applicable to toxins with either known crystal structures or where a good quality homology model can be built based on a structure of a closely related family member.

In certain embodiments, disabled protein toxins can be expressed with recombinant DNA constructs in which a polynucleotide molecule with the open reading frame encoding the protein is operably linked to elements such as a promoter and any other regulatory elements functional for expression in the system for which the construct is intended. For example, plant-functional promoters can be operably linked to the disabled protein toxin encoding sequences for expression of the protein in plants and *Bacillus thuringiensis* functional promoters can be operably linked to the disabled insecticidal protein toxin encoding sequences for expression of the protein in *B. thuringiensis*. Other useful elements that can be operably linked to the disabled protein toxin encoding sequences include, but are not limited to, enhancers, introns, leaders, encoded protein immobilization tags (e.g., HIS-tag), encoded sub-cellular translocation peptides (e.g., plastid transit peptides, signal peptides), encoded polypeptide sites for post-translational modifying enzymes, ribosomal binding sites, and the like.

An embodiment of the invention includes recombinant polynucleotide compositions that encode disabled protein toxins, such as those set forth in SEQ ID NOs: 3, 5, 7, 11, 15, 21, 23, 25, 27, 29, 35, 39, 43, 47, 51, 55, 59 and 63 encoding amino acid sequences set forth in SEQ ID NOs: 4, 6, 8, 12, 16, 22, 24, 26, 28, 30, 36, 40, 48, 52, 56, 60, and 64 respectively.

Examples of methods for testing and selecting disabled protein toxins include administering varying amounts of an insecticidal protein toxin and a disabled protein toxin in a diet to a target insect pest under controlled assay conditions (e.g., using molar ratios varying from 1:0 to 1:100, respectively). Results are evaluated by measuring and comparing the toxic potency of the fully-functional insecticidal protein toxin in the presence and absence of the disabled protein toxin. A statistically robust concentration-response value used for comparison would be the disabled protein toxin concentration which suppresses the insecticidal toxin effect (e.g., mortality, stunting) by 50% (inhibitory concentration or IC50).

EXAMPLES

In view of the foregoing, those of skill in the art should appreciate that changes can be made in the specific aspects which are disclosed and still obtain a like or similar result without departing from the spirit and scope of the invention. Thus, specific structural and functional details disclosed herein are not to be interpreted as limiting. It should be understood that the entire disclosure of each patent, patent application, and publication referenced herein are incorporated herein by reference in their entirety.

Example 1

This example illustrates methods for producing a disabled toxin (DT) from a fully functional pesticidal protein (FFPP) by starting with an exemplary toxin protein, a Bt insecticidal pore forming protein (Cry1Ab), consisting of the amino acid sequence as set forth in SEQ ID NO:2.

Methods are known in the art for introducing changes into the primary structure of a protein.

Site-directed (also referred to as "site-specific") mutagenesis was used to introduce coding sequence modifications to a nucleic acid sequence encoding a Cry1Ab toxin, a FFPP that, when provided in the diet of target insect pest larvae, is able to cause morbidity and/or mortality to such target insect pests. The nucleic acid sequence modifications are designed to result in the construction of a nucleotide coding sequence encoding one or more amino acid sequence variations within the Cry1Ab amino acid sequence, decreasing or eliminating the variant proteins' ability to form pores, to aggregate together with other Cry1Ab toxin molecules, into a pore complex, and therefore lacking the ability to cause morbidity and/or mortality to target insects in the same way as the unmodified FFPP Cry1Ab. The disabled Cry1Ab toxin (DT) is no longer able to exhibit any substantial toxic effect when provided in the diet at high concentrations to the applicable target pest, but is demonstrated to be competitive with the unmodified FFPP from which the DT was formed, likely by binding at the same receptor binding site and inhibiting binding of the unmodified FFPP. It is preferred that the modifications to an FFPP that is a characteristic Cry-class protein exhibiting a typical three-dimensional structure having domains I, II, and III, be limited to amino acids within the domain I architecture of the three domain Cry toxin because this domain is typically the segment that is primarily responsible for membrane penetration and pore formation. Domains II and III of such three domain toxins are involved in insect receptor binding and the present invention is intended to avoid disrupting the receptor binding amino acid segments of FFPP protein toxins regardless of their three-dimensional architecture. The examples described herein illustrate modifications that produce disabled toxins (DT's), and the use of such disabled toxins to confirm (i) any DT's interference with binding of the unmodified FFPP from which the DT is derived; (ii) any DT's interference with certain other and unmodified (i.e., different) FFPP's other than that from which the DT is derived, which then illustrate the overlap of binding of such other different FFPP's with the unmodified FFPP from which the DT is derived, illustrating the practicality of avoiding combinations of such FFPP's that exhibit such overlapping binding characteristics with the unmodified FFPP from which the DT is derived; and (iii) the absence of interference with the binding of certain other FFPP's that are different from the unmodified FFPP from which the DT is derived, illustrating the specific different FFPP's which should be considered useful for combinations with the unmodified FFPP from which the DT is derived. These are the bases for the utility of the present invention. The rapid identification of those different FFPP's that are compatible for use with the unmodified FFPP from which the DT is derived in compositions and in plants to control an applicable single target pest that is susceptible to two or more different FFPP's in a single commercial embodiment. The conservative nature of the proteins within the Cry1 class of toxin proteins makes the changes are shown here as having been introduced into the Cry1Ab amino acid sequence as set forth in SEQ ID NO:4, 6 and 8 (when each are compared to the unmodified Cry1Ab amino acid sequence as set forth in SEQ ID NO:2) effective when introduced into other closely related Cry1's having these amino acid residues at these positions, and guides the person of skill in the art to understanding the positions in different toxin proteins that may result in similar effects when such modifications are introduced into other sequence-related proteins including chimeras containing Cry1A related domain I segments.

Crosslinking cysteine residues that are artificially introduced into amino acid segments as supplementary amino acids or as substitutions into positions within the FFPP toxin protein amino acid sequence can result in inactivation of the ability of the modified toxin to confer toxicity, provided that such cysteine insertions or substitutions do not interfere with the modified toxin's ability to bind to the applicable receptor in the gut of the target insect to which the unmodified FFPP also binds. Bt insecticidal toxins undergo oligomerization and conformational transitions into transmembrane pore assemblies following binding to specific insect gut receptors. Therefore, pore formation can be prevented by placing restraints on the mobility of structural elements in the pore-forming components of the toxin protein. As exemplified herein, mobile elements in a toxin that are responsible for pore formation, and thus the toxic features of the pesticidal protein, can be impeded by introducing cysteine residues in the toxin protein amino acid sequence, so that each such cysteine substitution or insertion is too far apart in three dimensional conformational space to allow for direct disulphide formation, but which are within a proximity to each other in three dimensional space within the architecture of the modified toxin protein to be irreversibly crosslinked with homobifunctional sulthydryl-reactive crosslinking reagents, such as iodoacetamides (e.g., N,N'-ethylenebis (iodoacetamide)) or maleimides (e.g., bis(maleimido) ethane) or similar functional crosslinkers. Such crosslinking will cause a significant if not total loss of the ability of the protein to exhibit any toxic effects, but will not diminish the modified proteins' (DT) ability to bind to the cognate receptor to which the unmodified FFPP from which the modified protein (DT) has been derived is also able to bind. Creation of disabled toxins using this method entails selection of two suitable residues (typically positioned at least about 8-10Å apart), introducing changes into the nucleotide sequence encoding the toxin that results in a cysteine amino acid to be substituted for the normal amino acid at these spaced residue positions, expressing the modified protein containing the cysteine residues, and cross-linking the cysteines within the individual proteins expressed from the modified coding sequence with a homo-bifunctional reagent, similar to those described above. The modified FFPP amino acid sequence variant toxin will be able to bind to the cognate receptor but not cause toxic pore formation, and can be demonstrated to compete for receptor binding with the unmodified FFPP form of the toxin from which the cysteine modified disabled toxin (DT) has been derived.

The disabled Cry1Ab3-DIP3 protein containing the amino acid sequence variant residues 1109C/D129C in helices 3 and 4 of domain 1 was completely inactive towards multiple lepidopteran species in the absence of any crosslinking. The crystal structure of the protein provided evidence that the two cysteine residues are not oxidized to a disulfide bridge, but rather they comprise free sulfhydryl groups in the 1109C/D129C variant. In addition, we also found that both the soluble, pre-proteolyzed form of this toxin and its precursor crystal/spore preparation were disabled. The fact that the crystal/spore preparation of the native Cry1Ab has insecticidal activity on these target lepidopteran pests indicates that the insect lumen in these pests has a physiological environment sufficient to reduce multiple disulfide bridges interconnecting the protoxins in the crystalline form. Thus, it is unlikely that this protein would re-oxidize between helices 3 & 4 in the lumen following ingestion. A more plausible disabling mechanism is the disruption of self-oligomerization. Numerous contributions are already published on elucidating the function of helix 3 and 4 of Cry1A proteins by characterizing single point mutants, and these studies suggest that some of the helix 3 and 4 positions are critical for insecticidal activity and pore-formation. Vachon and Girard et al. (Vachon, Prefontaine et al. 2004, Girard, Vachon et al. 2008, Girard, Vachon et al. 2009) showed that cysteine mutagenesis of the helix 4 E129 position resulted in loss of bioassay activity as well as loss of pore-formation (osmotic shock) in brush border membrane. The same group communicated that E129C has unaltered BBMV binding inferred from the pore-formation assay set up as competition between wildtype toxin and variant. Because their competitive binding assay is set up with a pore-formation assay read-out, the results cannot readily distinguish between competition binding and oligomer poisoning. Additional insights to the same position were published by Rodríguez-Almazán et al. (Rodríguez-Almazán C 2009) showing that the E129K variant is inhibiting its native counterpart via oligomer poisoning. Regarding the helix 3 positions, Jimenez-Juarez et al. (Jimenez-Juarez, Munoz-Garay et al. 2007) reported on a helix 3 mutagenesis study that identified two variants, R99E (which was used as a control in this application) and Y107E, that lost its insecticidal activity, and were characterized as non-functional oligomers with reduced stability. Taken together, the hypothesis could be that helix 3 and 4 comprise an extensive surface for self-oligomerization that is fully disrupted upon stacking key mutations in helix 3 and 4. Single point mutants showed partial reduction of self-oligomerization and therefore a concomitant oligomer poisoning dominant negative effect in competition assays; thus, these probes are not ideal if one wants to observe receptor utilization in isolation. Our studies suggest that the 1109C/D129C variant residues in Cry1Ab completely disrupt the oligomerization step, given that (i) a large excess of the disabled toxin (DT) competitor was required to inhibit the homologous native protein, and (ii) Cry1A.105 normally insecticidal protein was not competed by a Cry1A.1088 disabled toxin even though these are both chimeric proteins that share the same domain 1, whose function is associated with both the oligomerization and pore-formation steps.

Initial studies with Cry1Ab3 variants demonstrated that Cry1Ab3-DIP3, containing the 1109C/E129C substitutions, satisfied criteria for use as a disabled toxin (DT) in mode of action studies. The disabled protein Cry1Ab3-DIP3 exhibited 1) no significant insecticidal activity towards any of the lepidopteran species tested, 2) no detectable ion channel activity in planar lipid bilayer experiments, 3) no apparent differences in susceptibility to processing with trypsin, 4) no significant competition in bioassays with the native Cry1Ab3 protein at molar concentrations of 1:1, and 5) significant competition with Cry1Ab3 in feeding assays with multiple lepidopteran species when presented in a molar excess of ≥10. Crosslinking of the engineered cysteine residues with EBI was not required to inactivate the protein, a feature that provides additional uses for the protein as discussed below. This method enables the skilled artisan to classify Cry proteins or other insecticidal proteins into groups that are likely to share receptor binding sites and to prioritize insecticidal proteins that appear to operate via an independent mode of action, as evidenced by the absence of any competition in insect bioassays. Finally, because the method only requires a validated insect bioassay, it is possible to assess competition quickly across a wide range of insect target species.

Example 2

This example illustrates the competition for receptor binding between an unmodified FFPP Cry1Ab toxin and several Cry1Ab amino acid sequence variants (each a different DT) that are each demonstrated to be unable to exert toxic effects upon the target insect species, and which are each unimpaired from binding to the receptor to which the unmodified FFPP also binds.

Three different DT's, each a Cry1Ab disabled toxin, were generated from an unmodified FFPP Cry1Ab amino acid sequence as set forth in SEQ ID NO:2, and each shown to compete with the unmodified Cry1Ab in bioassays using three different insect species, each shown also to be susceptible to unmodified Cry1Ab. Disabled toxins Cry1Ab _1 (DTI having the amino acid sequence as set forth in SEQ ID NO:4) and Cry1Ab_2 (DT2 having the amino acid sequence as set forth in SEQ ID NO:6) were produced by introducing amino acid sequence changes in Domain I of the FFPP Cry1Ab toxin amino acid sequence set forth in SEQ ID NO:2, and the changes introduced are shown in Table 1. DT1 contains a single amino acid substitution, R99E, which results in disabling the toxic properties of the FFPP Cry1Ab protein in applicable target pest species. DT2 contains two different amino acid substitutions, E129K and D136N, together resulting in the disabling of the toxic properties of the FFPP Cry1Ab protein in applicable target pest species. Cry1Ab_3 (DT3 having the amino acid sequence as set forth in SEQ ID NO:8) was produced by substitution of two spatially separated amino acids in the amino acid sequence of Cry1Ab as set forth in SEQ ID NO:2 with cysteine residues, using the method as described above in Example 1. A cysteine residue was substituted for isoleucine at amino acid position 109 and a cysteine substituted for glutamate at position 129 within the primary amino acid sequence of Cry1Ab as set forth in SEQ ID NO:2. Variant Cry1Ab_3 (DT3), was designed so that the cysteine residues are surface exposed and then capable of being crosslinked with homobifunctional reducing agents as described above in Example 1.

TABLE 1

Toxicity Disabling Cry1Ab Modifications

| Cry protein | Alias | Amino Acid Sequence Set Forth in SEQ ID NO: | Amino Acid Changes | Protein type |
|---|---|---|---|---|
| Cry1Ab | FFPP | 2 | — | Unmodified Cry1Ab toxin |
| Cry1Ab_1 | DT1 | 4 | R99E | Disabled Cry1Ab toxin |
| Cry1Ab_2 | DT2 | 6 | E129K, D136N | Disabled Cry1Ab toxin |
| Cry1Ab_3 | DT3 | 8 | I109C, E129C | Disabled Cry1Ab toxin |

Insect bioassays were conducted using the toxic and unmodified form of FFPP Cry1Ab (SEQ ID NO:2) and the disabled Cry1Ab modified proteins (DT1, DT2, and DT3) having the amino acid sequences as set forth respectively in SEQ ID NO:4, SEQ ID NO:6, and SEQ ID NO:8) to establish concentrations of unmodified Cry1Ab required to titrate the mortality curve for each target insect species tested and to confirm that each DT was devoid or substantially devoid of any pesticidal activity in the applicable target insect species when tested at high concentrations. Subsequently, the unmodified Cry1Ab (FFPP) protein was mixed with each disabled toxin at molar ratios of 1:1 and 1:10 and tested in insect bioassay to determine the extent to which the disabled toxin (DT) suppresses the unmodified FFPP Cry1Ab. Table 2 shows the results of a bioassay using *Manduca sexta* (Tobacco hornworm, THW) as the target insect species. In this example, 0.04 ppm samples of unmodified FFPP Cry1Ab resulted in severe stunting of the larvae while 4 ppm samples of each disabled toxin tested alone exhibited no significant activity (a 100-fold increase in concentration of the DT compared to the unmodified toxin). When each DT was combined in a 1:1 molar ratio with unmodified FFPP Cry1Ab, little or no effect was observed on unmodified Cry1Ab activity, although the unmodified Cry1Ab+DT2 mixture was less active than unmodified Cry1 Ab when tested in the absence of DT2. When each DT was tested at a 10 fold excess compared to the amount of unmodified FFPP Cry1Ab, both DT2 and DT3 each independently suppressed the activity of Cry1Ab, illustrating that the disabled toxins DT2 and DT3 were each able to compete for the unmodified FFPP Cry1Ab receptor without causing any mortality or morbidity.

DT1 was less effective in suppressing the activity of unmodified FFPP Cry1Ab when presented in ten-fold molar excess, but the activity of the mixture was notably lower than that of the activity when unmodified FFPP Cry1Ab was tested alone. Similar results were obtained using *Heliothis virescens* (tobacco budworm, TBW) as the target pest species (data presented in Table 3). In this assay, the stunting data results demonstrate that (1) DT2 and DT3 show little or no activity against TBW, (2) neither DT2 nor DT3 impacts the activity of unmodified FFPP Cry1Ab when presented in a 1:1 molar ratio, and 3) both DT2 and DT3 suppress the activity of unmodified FFPP Cry1Ab when each DT is presented in the assay in a ten fold molar excess. These results are consistent with those obtained using *Manduca sexta* as the target pest species. However, in this assay the disabled toxin DT1 displayed significant stunting effects in TBW at the concentration tested and thus could not be used to suppress the activity of unmodified FFPP Cry1Ab toxin.

TABLE 2

Disabled Cry1Ab Competes with Unmodified Cry1Ab for Receptor Binding in THW

| SEQ ID NO:/ Cry Protein | Active on THW | Homologous Competition Against Cry1Ab in THW 1:1 | 1:10 |
|---|---|---|---|
| 2/FFPP Cry1Ab | + | NA | |
| 4/DT1 | - | - | - |
| 6/DT2 | - | - | + |
| 8/DT3 | - | - | + |

*Ostrinia nubilalis* (European corn borer, ECB) was also tested as a target pest species and the results are shown in Table 3. The data summarized in Table 3 indicate that 1) each of the different DT's exhibit no significant toxic activity when tested against ECB at 50 ppm, 2) the three DT's have no significant impact on the activity of unmodified FFPP Cry1Ab when presented at a 1:1 molar ratio, and 3) all three disabled toxins suppress the activity of unmodified FFPP Cry1Ab when each are present at a 10 fold molar excess.

TABLE 3

Disabled Cry1Ab Competes with Unmodified FFPP Cry1Ab for Receptor Binding in Target Pests TBW and ECB

| SEQ ID No:/ Cry Protein | Homologous Competition Against Cry1Ab in TBW | Active on ECB | Homologous Competition Against Cry1Ab in ECB 1:1 | 1:10 |
|---|---|---|---|---|
| 2/Cry1Ab | NA | + | NA | |
| 4/DT1 | NA | - | - | + |
| 6/DT2 | + | - | - | + |
| 8/DT3 | + | - | +/- | + |

Example 3

This example illustrates that identifying that a first DT derived from a first unmodified FFPP that competes with a second unmodified FFPP different from the first, and that a second DT derived from the second unmodified FFPP competes with the first unmodified FFPP, is determinative that the first and second unmodified FFPP's are not compatible for use together in an insect resistance management system, i.e., the two unmodified FFPP's are likely to be capable of binding to the same or substantially similar receptors in an applicable target pest species, and therefore are not candidates for use together in a composition for controlling the pest, even though both toxins may be effective at controlling the target pest. This is because the likelihood of development of resistance to one of the toxins is high, and the development of resistance to one of the toxins would likely be effective in reducing or eliminating the other toxin's ability to control the same target pest.

In this example, two different lepidopteran toxic chimeric FFPP proteins, a TIC105 (composed of Domain I and II of Cry1Ab and Domain III of Cry1Fa and having the amino acid sequence as set forth in SEQ ID NO:10) and TIC107 (composed of Cry1Ab domains I and II and Cry1Ac Domain III and having the amino acid sequence as set forth in SEQ ID NO:14) are each used separately to derive disabled toxin amino acid sequence variants (DT's) that rely on the incorporation of two cysteine residues within Domain I of each of these different chimeric FFPP's, substituting each of isoleucine at position 109 and glutamate at position 129 with a cysteine. The disabled toxin amino acid sequences for each of these DT proteins arc set forth in SEQ ID NO:12 (modified T1C105, DT4) and SEQ ID NO:16 (modified TIC107, DT5). The disabled toxins DT4 and DT5 were each tested for insect toxicity and competition with their respective FFPP's from which they were each derived, against the target pest species Diatraea grandiosella (southwestern corn borer, SWCB), Helicoverpa zea (corn earworm, CEW) and Spodoptera frugiperda (fall armyworm, FAW), which are each known to be sensitive to each of the unmodified FFPP's TIC105 and TIC107. Similar to the examples above, the molar ratios used to determine efficacy of the system for making and observing these binding comparisons was established by titration with increasing concentrations of the disabled proteins. Concentrations of 1:1 and 1:20 molar excess of each of the DT's was used for making comparisons when testing with SWBC and with FAW, and a 1:80 molar excess was required for making the comparisons when testing in CEW, as complete suppression of mortality by the DT's was not observed unless the DT was included at the higher concentration.

The results of testing the unmodified chimeric toxins alone and together with each of the respective DT's arc shown in Tables 4 and 5.

TABLE 4

Disabled Chimeric Toxins Are Competitive with Unmodified Chimeric Toxins When Tested in SWCB

| SEQ ID NO:/ Cry Protein | Amino Acid Substitutions | Active on SWCB | Homologous Competition Against FFPP Toxin in SWCB 1:1 1:20 |
|---|---|---|---|
| 10/TIC105 | — | + | NA |
| 12/DT4 | I109C, E129C | − | +/− + |
| 14/TIC107 | — | + | NA |
| 16/DT5 | I109C, E129C | − | − + |

TABLE 5

Disabled Chimeric Toxins Compete with Unmodified Toxins for Receptor Binding in CEW and FAW

| SEQ ID No:/ Cry Protein | Active on CEW | Homologous Competition Against Parent Toxin in CEW 1:1 1:80 | Active on FAW | Homologous Competition Against Parent Toxin in FAW 1:1 1:20 |
|---|---|---|---|---|
| 10/TIC105 | + | NA | + | NA |
| 12/DT4 | − | − + | − | − + |
| 14/TIC107 | + | NA | + | NA |
| 16/DT5 | − | − + | − | − + |

Both disabled toxins, DT4 and DT5, exhibit strong homologous competition with their respective FFPP's from which these were derived in the SWCB and FAW assays, with a compete suppression of mortality observed at only twenty-fold molar excess of the disabled toxin. However, against CEW, DT4 exhibits only partial homologous competition at eighty-fold molar excess, as mortality was observed at a twenty-fold molar excess. In contrast, DT5 exhibits strong homologous competition in the CEW assay. These results suggest that the DT's have a diminished affinity for the same receptor that the respective chimeric protein is targeting for binding, or possibly that there is more than one receptor being targeted for binding and that the disablement of the respective toxin has only partially inhibited the binding of the toxin to one or to both.

Example 4

This example teaches heterologous competition between a first disabled toxin 1-DT derived from a first FFPP (1-FFPP) and a second FFPP (2-FFPP) different from the first FFPP by at least one amino acid, wherein both 1-FFPP and 2-FFPP are each toxic to the same target pest. The example teaches specifically the testing for efficacy of the three disabled toxins described in Example 2 (DT1, DT2, and DT3) in suppressing the insecticidal activity of toxins that are not the same as the unmodified FFPP Cry1Ab from which the three disabled toxins were derived.

Specifically tested were two FFPP's that are different from Cry1Ab. Cry1Ab in this Example 4 is referred to as 1-FFPP, and has the amino acid sequence as set forth in SEQ ID NO:2). TIC105, referred to in this Example 4 as 2-FFPP, has the amino acid sequence as set forth in SEQ ID NO:10. Cry2Ab, referred to in this Example 4 as 3-FFPP, has the amino acid sequence as set forth in SEQ ID NO:18. TIC105 is a chimeric Cry1A protein sharing significant sequence similarity with Cry1Ab across the Domains I and II segments, while Cry2Ab is known to exhibit a mode-of-action that is distinct from that of Cry1Ab and neither protein has any significant overlap of amino acid sequence identity or similarity. For initial assays, a maximum concentration of disabled toxin (50 ppm) was used in mixtures with the active unmodified FFPP toxins.

Results from studies using THW are shown in Table 6. As expected, competition was observed when the disabled Cry1Ab proteins DT1, DT2 and DT3 were tested in assays with the unmodified FFPP Cry1Ab (1-FFPP). No competition was observed when these Cry1Ab disabled toxins DT1, DT2 or DT3 were tested in bioassays in which the unmodified FFPP was Cry2Ab (3-FFPP), consistent with the view that Cry1Ab and Cry2Ab each bind to different target receptors.

With reference to the TIC105 data, a differential effect was observed with the different disabled toxins. DT2 exhibited complete suppression of TIC105 (2-FFPP) activity, while DT1 and DT3 showed no heterologous competition when tested against 2-FFPP. The suppression observed by DT2 may be due to a "dominant negative" phenotype associated with this disabled toxin, an effect that may not be due to competition for receptor binding but rather to interference with ion channel assembly and activity (see for example, Rodriguez-Almazan et al. (2009) PloS ONE: e5545). In this case, DT2 may not be competing for TIC105 (2-FFPP) receptor binding sites, but instead is forming hetero-oligomers with the TIC105 toxin resulting in a complex that is defective in forming ion channels or pores.

The results with tobacco budworm (TBW) are also shown in Table 6. in this assay, mortality was low across all treatments, so stunting data was evaluated instead. The disabled toxins DT2 and DT3 exhibit complete suppression of Cry1Ab (1-FFPP), partial suppression of TIC105 (2-FFPP), and no suppression of Cry2Ab (3-FFPP). These results suggest a partial overlap in the receptor binding sites of Cry1Ab and TIC105 and no overlap between the receptor binding sites of Cry1Ab and Cry2Ab in TBW.

The stunting data with *Diatraea grandiosella* (southwestern corn borer; SWCB) indicate no competition between the DT's tested and Cry2Ab (3-FFPP), or when tested with TIC105 (2-FFPP) (Table 6). The disabled toxins DT2 and DT3 were both effective in suppressing the activity of Cry1Ab (1-FFPP) in this species.

TABLE 6

Disabled Toxin Competitive Binding with Heterologous Toxins Tested in THW, TBW and SWCB

| SEQ ID No:/Cry Protein | Active on THW | Heterologous* Competition in THW | Active on TBW | Heterologous* Competition in TBW | Active on SWCB | Heterologous* Competition in SWCB |
|---|---|---|---|---|---|---|
| 2/Cry1Ab | + | NA | + | NA | + | NA |
| 4/DT1 | − | + | − | − | − | + |
| 6/DT2 | − | + | − | + | − | + |
| 8/DT3 | − | + | − | + | − | + |
| 18/Cry2Ab2 | + | NA | + | NA | + | NA |
| 4/DT1 | − | − | − | − | − | − |
| 6/DT2 | − | − | − | − | − | − |
| 8/DT3 | − | − | − | − | − | − |
| 12/TIC105 | + | NA | + | NA | + | NA |
| 4/DT1 | − | − | − | − | − | − |
| 6/DT2 | − | + | − | + | − | − |
| 8/DT3 | − | + | − | + | − | − |

*Competition is homologous with respect to Cry1Ab.

Example 5

Homologous Competition between Cry51 Aa and Disabled Toxin Amino Acid Sequence Variants This example illustrates the effect of producing disabled β-pore forming toxins DT6, DT7, DT8, and DT9 and testing these against the unmodified FFPP β-pore forming toxin from which these are derived (a Cry51Aa toxin, having the amino acid sequence as set forth in SEQ ID NO:32, TIC834_14) for competition with at least one common receptor. SEQ ID NO:32 is illustrative of a member of the β-pore-forming insecticidal crystal protein class and is also referenced herein as a Cry51Aa toxin (i.e., alternatively referred to as a Cry51Aa2 or Cry51Aa2.834_14 and each referred to as a BFFPP, Cry51Aa2.834_14 and TIC834_14 alternatively referred to herein as ßFFPP-2).

ßFFPP-2 exhibits insecticidal activity against Hemipteran insects, including *Lygus* species such as *Lygus lineolaris* (tarnished plant bug) and *Lygus hesperus* (western tarnished plant bug) (see U.S. Patent Application No. 2013/0269060, in which TIC834 14 and TIC834 16 are each referenced).

In this Example 5, four different disabled variants of ßFFPP -2 were generated and are shown to compete with ßFFPP-1, a TIC843_16, having the amino acid sequence as set forth in SEQ ID N0:20, an unmodified insecticidal protein that exhibits improved activity in bioassays against *Lygus hesperus* and *Lygus lineolaris*. The disabled toxins and the modifications that have been introduced into these are shown in Table 7. The ßFFPP-1 and ßFFPP-2 are indistinguishable in bioassays in this Example, even though the are not identical, i.e., the ßFFPP-2 sequence contains an alanine at amino acid sequence position 248 and an arginine at position 270 compared to ßFFPP-1 which sequence contains a valine and a tryptophan, respectively, at these same positions.

It has been shown that β-pore-forming toxin activity involves formation of heptameric oligomers with a central pore generated from stem loop structures (see, for example, Tanaka, Y., et al. (2011) Protein Science 20, 448-456 and De, S. and Olson, R. (2011) Proc. Natl. Acad. Sci. 108, 7385-7390). In these pores, the stem loops are amphipathic, antiparallel beta-strands, with the hydrophilic side lining the pore solvent channel and the hydrophobic pore face directed toward the hydrophobic membrane. Prior structural characterization of ßFFPP (see U.S. Patent Application No. 2013/0269060, in which TIC834 is referenced as TIC807) has revealed an amphipathic beta-pore-forming loop (bPFL).

The strategy to produce disabled toxins of ßFFPP toxins ßFFPP-1 or ßFFPP-2 involved selected mutagenesis and subsequent chemical modification centered on the bPFL to inhibit productive pore formation. Specifically, double cysteine (Cys) amino acid sequence variants of ßFFPP-2 were designed so that cysteine residues were substituted for cognate amino acids at positions within the amino acid sequence and with sufficient spacing that the Cys residues could be crosslinked covalently with a bifunctional reducing reagent, such as N,N'-ethylene bis (iodoacetamide). Two types of double Cys variants were designed: type (a) variants with both Cys residues within the bPFL and on the hydrophilic face, and type (b) variants with one Cys residue within the bPFL on the hydrophilic face and another within the adjoining protein structure.

Type (a) double Cys variants include DT8 (ßFFPP-1 modified to contain these type (a) cysteine substitutions and having the amino acid sequence as set forth in SEQ ID NO:26) and DT9 (ßFFPP-1 modified to contain these type (a) cysteine substitutions and having the amino acid sequence as set forth in SEQ ID NO:28). Type (b) double Cys variants include DT6 (ßFFPP-1 modified to have these type (b) cysteine substitutions and having the amino acid sequence as set forth in SEQ ID NO:22), and DT7 (ßFFPP-1 modified to have these type (b) cysteine substitutions and having the amino acid sequence as set forth in SEQ ID NO:24). The specific amino acid positions which were modified by cysteine substitution are shown in Table 7 and as exemplified in the sequences as set forth in the Sequence Listing.

TABLE 7

Disabled toxin Amino Acid Sequence Variants of ßFFPP

| Cry protein | SEQ ID NO: | Amino Acid Sequence Modifications | Protein type |
|---|---|---|---|
| ßFFPP | 20 | — | ßFFPP |
| DT6 | 22 | D55C, S117C | DT |
| DT7 | 24 | D55C, S131C | DT |
| DT8 | 26 | P121C, T129C | DT |
| DT9 | 28 | P121C, T133C | DT |

The four ßFFPP DT proteins DT6, DT7, DT8 and DT9 were expressed in an acrystalliferous strain of *B. thuringiensis*. After purification and prior to cross-linking, the DT protein samples were dissolved in 50 mM carbonate-pH 9.2, 200 mM NaCl. A 20 mM N,N'-ethylene bis (iodoacetamide) stock solution was prepared by dissolving the reagent in DMSO, which was added at 10× the molar protein concentration. Mass spectral analyses were conducted on samples, before and after reaction with the bifunctional reagent, to verify that productive crosslinking had occurred.

Insect diet bioassays were run individually with the unmodified ßFFPP-1 protein and individually with each of the four disabled variants DT6, DT7, DT8 and DT9 to (a) establish tittered concentrations of unmodified ßFFPP-1 required to cause significant mortality for each insect species tested, and (b) confirm that the disabled proteins retain little or no insecticidal activity at high concentrations. Subsequently, the unmodified ßFFPP-1 was mixed separately with each disabled toxin at three different molar ratios (1:2, 1:20 and 1:50) in which each DT was present in excess, and tested in insect bioassays to determine the level of suppression of the unmodified toxin that each disabled toxin is able to provide. Table 8 shows the results of bioassays using the target insect pest *Lygus lineolaris* (tarnished plant bug).

TABLE 8

Disabled Toxins DT6, DT7, DT8, and DT9 Compete with Unmodified ßFFPP-1 Toxin for Receptor Binding in *Lygus lineolaris* (tarnished plant bug)

| SEQ ID NO:/ Cry Protein | Active on *L. lineolaris* | Homologous Competition Against ßFFPP in *L. lineolaris* |
|---|---|---|
| 20/ßFFPP | + | NA |
| 22/DT6 | − | + |
| 24/DT7 | − | + |
| 26/DT8 | − | + |
| 28/DT9 | − | + |

DT7 was most effective in suppressing the activity of ßFFPP-1, while DT6, DT8 and DT9 were less effective. Each of the crosslinked disabled variants exhibited insignificant levels of toxicity, while samples of these variants that were not exposed to N,N'-ethylenebis(iodoacetamide) exhibited significant levels of toxicity illustrating that the substitution of the natural amino acids at the specified positions with cysteines was not significantly detrimental to the toxic pore forming properties of these proteins. For example, the non-crosslinked version of DT7 at 200 ppm resulted in 88% mortality, while crosslinked DT7 at 2000 ppm had a negligible effect. In addition, disabled variant DT7 was also effective in suppressing the activity of ßFFPP-1 in diet bioassay testing against *Lygus hesperus* (western tarnished plant bug). DT7 alone (crosslinked) exhibited no toxicity against *L. hesperus*.

These results illustrate that the unmodified ßFFPP-1 and the disabled forms of this toxin, DT6, DT7, DT8, and DT9 each bind to the same set of receptors, and also illustrate the speed with which a more rapid and efficient means for identifying combinations of two or more toxins that can be used together to control a single target pest species susceptible to each of the toxins, i.e., toxins that do not compete for the same receptor, and therefore provide a more durable pest control product that is less susceptible to the development of resistance.

Example 6

Assessment of the Contribution of TIC105 and Cry2Ab to Soybean Looper Control Using Premixed Lyophilized Soybean Leaf Tissue This example illustrates the use of two different disabled toxins derived from two different unmodified toxins, to demonstrate the relative contribution of each toxin to control Soybean looper (*Chrysodeixis inchtdens*) using premixed lyophilized soybean leaf tissue samples from transgenic soybean plants expressing the insect toxins TIC105 or Cry2Ab.

Leaf tissue samples were obtained from two different transgenic soybean events, one expressing the insect toxin TIC105 and the other expressing Cry2Ab. The tissue samples were then lyophilized into a powder and added to an insect diet alone and in various combinations. The ratio of toxin in each sample was adjusted to provide a specific ratio of LC values, ranging from LC10 to LC90 for each toxin. The amounts of tissues to be premixed were determined in a separate tissue dilution experiment for both single events, and the mixtures represent a combined approximate LC95 dose. Table 9 shows the results of these combinations.

TABLE 9

LC95 Combinations of FFPP TIC105 and FFPP Cry2Ab and Corresponding Concentration of Lyophilized Soybean Event Tissue.

| TIC105(LC) + Cry2Ab(LC) | (X)mg/ml TIC105 + (Y)mg/ml Cry2Ab |
|---|---|
| TIC105 (LC10) + Cry2Ab2 (LC90) | 0.2 mg/ml TIC105 + 7.8 mg/ml Cry2Ab |
| TIC105 (LC30) + Cry2Ab2 (LC70) | 0.6 mg/ml TIC105 + 5.6 mg/ml Cry2Ab |
| TIC105 (LC50) + Cry2Ab2 (LC50) | 1.0 mg/ml TIC105 + 4.0 mg/ml Cry2Ab |
| TIC105 (LC70) + Cry2Ab2 (LC30) | 1.4 mg/ml TIC105 + 2.4 mg/ml Cry2Ab |
| TIC105 (LC90) + Cry2Ab2 (LC10) | 1.8 mg/ml TIC105 + 0.8 mg/ml Cry2Ab |

Combinations of TIC105 and Cry2Ab that result in LC95 toxic effects against Soybean looper; Column 1, purified TIC105 and Cry2Ab mixtures; Column 2, extrapolated amounts of toxin present in lyophilized powders of soybean events expressing each of these proteins.

Increasing concentrations of the disabled toxins, DT4 or DT10 separately, or both DT4 and DT9 in combinations, were presented as a diet overlay in concentrations of 0.1, 1.0, and 2.0 milligrams per milliliter (mg/ml) over the insect diet comprising the TIC105 and Cry2Ab lyophilized tissue samples. First instar Soybean looper larvae were allowed to feed on the insect diet for four days. Mortality and stunting was determined for each sample for each LC ratio. Loss of insecticidal activity due to the disabled toxin competition is presented in Table 10 below which shows the mean percent mortality for each LC ratio and corresponding overlaid disabled toxin(s).

TABLE 10

Mean percent mortality of Soybean looper larvae fed TIC105 and Cry2Ab in the presence of the disabled toxins, DT4 and DT10.

| TIC105 (LC) + Cry2Ab2(LC) | Disabled Toxin | Disabled Toxin (mg/ml) | Percent Mortality | SEM |
|---|---|---|---|---|
| TIC105 (LC10) + |  | 0 | 91.67 | 4.17 |
| Cry2Ab2 (LC90) | DT4 | 0.1 | 50.00 | 7.22 |
|  | DT4 | 1 | 47.62 | 2.38 |
|  | DT4 | 2 | 62.50 | 25.00 |
|  | DT10 | 0.1 | 25.00 | 0.00 |
|  | DT10 | 1 | 4.17 | 4.17 |
|  | DT10 | 2 | 16.67 | 8.33 |
|  | DT4 and DT10 | 0.1 | 4.17 | 4.17 |
|  | DT4 and DT10 | 1 | 0.00 | 0.00 |
|  | DT4 and DT10 | 2 | 0.00 | 0.00 |
| TIC105 (LC30) + |  | 0 | 87.50 | 0.00 |
| Cry2Ab2 (LC70) | DT4 | 0.1 | 52.98 | 9.91 |
|  | DT4 | 1 | 50.00 | 7.22 |
|  | DT4 | 2 | 37.50 | 7.22 |
|  | DT10 | 0.1 | 66.67 | 8.33 |
|  | DT10 | 1 | 41.67 | 8.33 |
|  | DT10 | 2 | 12.50 | 7.22 |
|  | DT4 and DT10 | 0.1 | 12.50 | 7.22 |
|  | DT4 and DT10 | 1 | 0.00 | 0.00 |
|  | DT4 and DT10 | 2 | 0.00 | 0.00 |
| TIC105 (LC50) + |  | 0 | 95.83 | 4.17 |
| Cry2Ab2 (LC50) | DT4 | 0.1 | 87.50 | 7.22 |
|  | DT4 | 1 | 33.33 | 11.02 |
|  | DT4 | 2 | 12.50 | 7.22 |
|  | DT10 | 0.1 | 91.67 | 4.17 |
|  | DT10 | 1 | 87.50 | 7.22 |
|  | DT10 | 2 | 37.50 | 0.00 |
|  | DT4 and DT10 | 0.1 | 33.33 | 4.17 |
|  | DT4 and DT10 | 1 | 0.00 | 0.00 |
|  | DT4 and DT10 | 2 | 0.00 | 0.00 |
| TIC105 (LC70) + |  | 0 | 95.83 | 4.17 |
| Cry2Ab2 (LC30) | DT4 | 0.1 | 45.83 | 15.02 |
|  | DT4 | 1 | 16.67 | 4.17 |
|  | DT4 | 2 | 16.67 | 4.17 |
|  | DT10 | 0.1 | 91.67 | 4.17 |
|  | DT10 | 1 | 54.17 | 15.02 |
|  | DT10 | 2 | 79.17 | 11.02 |
|  | DT4 and DT10 | 0.1 | 79.17 | 11.02 |
|  | DT4 and DT10 | 1 | 0.00 | 0.00 |
|  | DT4 and DT10 | 2 | 0.00 | 0.00 |
| TIC105 (LC90) + |  | 0 | 83.33 | 4.17 |
| Cry2Ab2 (LC10) | DT4 | 0.1 | 79.17 | 15.02 |
|  | DT4 | 1 | 58.33 | 18.16 |
|  | DT4 | 2 | 0.00 | 0.00 |
|  | DT10 | 0.1 | 87.50 | 7.22 |
|  | DT10 | 1 | 95.83 | 4.17 |
|  | DT10 | 2 | 70.83 | 15.02 |
|  | DT4 and DT10 | 0.1 | 62.50 | 19.09 |
|  | DT4 and DT10 | 1 | 16.67 | 11.02 |
|  | DT4 and DT10 | 2 | 0.00 | 0.00 |

In an earlier experiment, the disabled toxins DT4 and DT10 at one and two milligrams per milliliter dose, respectively, completely competed (i.e., tittered) the TIC105 and Cry2Ab single soybean tissues samples when these samples were not mixed. When these tissues were premixed, complete inhibition of the combined insecticidal activity of TIC105 and Cry2Ab could only be achieved when both disabled toxins were added as an overlay. When both tissues samples were combined at an LC50 value for each sample, loss of inhibition was greater for the DT4 disabled toxin at a concentration of 2 mg/ml when compared to the loss of inhibition for the DT10 disabled toxin at the same concentration; suggesting TIC105 plays a greater role in controlling Soybean looper than Cry2Ab.

Example 7

This example illustrates competition assay results between BCW003 disabled toxin DT11 and homologous and heterologous toxin proteins.

The examples using Cry1Ab3 disabled toxin demonstrated that the activities of BCW003 toxin (SEQ ID NO:34) and TIC105 toxin (SEQ ID NO:10) can be selectively abrogated depending on the insect species tested. The expanded set of Cry1A DP probes has enabled the evaluation of heterologous competition among different insecticidal proteins, again using SWC (southwest corn borer) as the test species due to its sensitivity to all of the insecticidal proteins included in this example. The disabled toxins corresponding to Cry1Ab3, TIC105, and BCW003 proteins each exhibited homologous competition with their respective native toxins from which the DT's were derived (see data in Table 11). Competition of DT's derived from these toxins (Cry1Ab3, TIC105, and BCW003) was not observed when tested with the more distantly related Cry1Ca and Cry2Ab2 proteins. With respect to Cry1A heterologous competition, neither the TIC105_3 (SEQ ID NO:12) nor BCW003 disabled toxin DT11 proteins exhibited competition with the TIC107 (Cry1Ac) native protein, suggesting that the unique domain 3 of TIC107 is critical for the observed SWC inhibitory activity. It was also observed that while Cry1Ab3_3 (SEQ ID NO:6) and TIC105_3 (SEQ ID NO:12) suppressed the activity of BCW003 (SEQ ID NO:34) toward SWC, DT11, the BCW003 disabled toxin variant, failed to suppress the activity of TIC105 in the SWC feeding assay.

TABLE 11

| SEQ ID NO:/ Cry protein | Amino Acid Sequence Modification | Active on SWCB | Competition Against FFPP Toxin in SWCB 1:1 1:25 |
|---|---|---|---|
| 34/BCW003 | — | + | NA |
| 36/DT11 | I109C, E129C | − | +/− + |
| 12/TIC105 | — | + | NA |
| 12/DT11 | I109C, E129C | − | − − |
| 14/TIC107 | — | + | NA |
| 14/DT11 | I109C, E129C | − | − − |
| 18/Cry2Ab | — | + | NA |
| 18/DT11 | I109C, E129C | − | − − |
| 38/Cry1Ca | — | + | NA |
| 38/DT11 | I109C, E129C | − | − − |

Example 8

This example illustrates competition assay results between Cry1Ca disabled toxin DT12 and homologous and heterologous toxin proteins.

Domain 1 sequences of Cry1Ca (SEQ ID NO:38) and Cry2Ab2 (SEQ ID NO:18) are very different from that of the Cry1Ab3 (SEQ ID NO:2) Domain 1 (57.6% and 25.3% identity, respectively). Structural information about these proteins was used to select a set of double cysteine mutations for each such toxin so that the two thiols are positioned and oriented favorably for EBI crosslinking. Taking into account structural flexibility, residue pairs were selected with β-carbon atoms (Cβ) 7.3-12 Å apart and pointing in the same direction. In cases where reactivity of the proposed amino acid substitutions might be sterically hindered by surrounding bulkier residues, the potentially conflicting residues were modified to smaller amino acids such as alanine or serine depending on the expected hydrophobicity at those positions. 61 Cry1Ca and 44 Cry2Ab2 designs were created and expressed in acrystalliferous *Bacillus thuringiensis*, and the variants that expressed well were tested in insect diet bioassay. The Cry1Ca variants were tested on SWC and the Cry2Ab2 variants were tested on CEW at an applied concentration of 1000 ppm. Knowing in advance that the Cry1A and toxins related to Cry1A disabled toxin candidates were shown to be inactive without crosslinking, non-crosslinked Cry 1Ca and Cry2Ab2 variants were tested first and the results identified several promising (i.e. inactive) protein variants for the follow-up homologous competition assay. Cry1Ca disabled toxin (DT12, SEQ ID NO:40) having the amino acid substitutions (N98C and D143C, and the Cry2Ab2 disabled toxin Cry2Ab2_6 (SEQ ID NO:30) having the amino acid substitutions G119C, N123A, L156C, and R160A satisfied the criteria for use as disabled proteins for competition studies, exhibiting homologous competition in insect assays with Cry1Ca and Cry2Ab2, respectively, at a high molar excess of the DT but not at a 1:1 molar ratio. Comparative analysis between Cry1Ca and Cry2Ab2 using their respective DT probes in the *C. includens* feeding assay showed that the respective DT for each protein was only able to compete out the activity of the native protein from with the applicable DT was derived; i.e. Cry2Ab _6 was only able to compete with the Cry2Ab native protein, and DT12 was only able to compete with Cry1Ca.

Example 9

This example teaches in vivo receptor binding assessment via competition assays between FAW-active insecticidal proteins and their respective DP variants. TIC844 (SEQ ID NO:42), when provided in the diet to FAW larvae at 690 ng/cm2 elicited a 98% insect stunting response, that was calculated based on the observed insect size in reference to the size of the positive control (100% response) and negative control (0% response). DP assays were then implemented to comparatively assess the receptor preferences of these native insecticidal proteins, and the proteins used and the data collected is shown in Table 13. TIC844 provided at 690 ng/cm2 when co-administered with DT13 (SEQ ID NO:44) exhibited (i) no competition at stoichiometric DP (1:1) to native insecticidal protein ratios, (ii) significant competition when DP was used 5-25 fold in excess of the native insecticidal protein, and (iii) full competition when the DP was used in 50-fold excess of the native toxin, where the insect phenotype was completely rescued, and the insect size was indistinguishable from the size of the negative control insects. When DT13 was co-administered separately with 5520 ng/cm2 TIC868 (SEQ ID NO:46), 20.7 ng/cm2 TIC842 (SEQ ID NO:50) and 2760 ng/cm2 Vip3A (SEQ ID NO: 54) (approximately an MIC95 dose), the insecticidal activity of these proteins was not inhibited, even in the presence of 138,000 ng/cm2 DT13 competitor, representing a 25-, 6,600-, and 50-fold DP to the native toxin challenge ratio, respectively. Similarly, homologous competition between native insecticidal proteins and their corresponding DIP variant was demonstrated for TIC868, TIC842, Vip3A, TIC105, and Cry2Ab. Heterologous competition was also assessed between each native and DP pairs, and the insecticidal activity of TIC844, TIC868, TIC842, and Vip3A was not inhibited even in the presence of high concentration DP competitor. These insecticidal proteins were evaluated against the disabled version of two commercial insecticidal proteins, TIC105 (SEQ ID NO:10) and Cry2Ab (SEQ ID NO:18). Significant (P<0.05) competition was not observed with the exception of the comparison between 690 ng/cm2 TIC844 and 138,000 ng/cm2 TIC105_3 (SEQ ID NO:12), which showed a mere 15% reduction of insecticidal response under experimental conditions where TIC105_3 fully competed against its native counterpart.

TABLE 13

| SEQ ID NO:/ Cry protein - Alone (A) or Parent/DT Mixtures (M) | Amino Acid Sequence Modification | FAW Activity | Competition Against the corresponding FFPP Toxin in FAW/(Challenge Ratio) |
|---|---|---|---|
| 42/TIC844 (A) | S282V, Y316S, I368P | + | NA |
| 46/TIC868 (A) | — | + | NA |
| 50/TIC842 (A) | — | + | NA |
| 54/Vip3A (A) | — | + | NA |
| 10/TIC105 (A) | — | + | NA |
| 18/Cry2Ab (A) | — | + | NA |
| 44/DT13 (A) | V108C, E128C, S282V, Y316S, I368P | − | NA |
| 48/DT14 (A) | A160N, N167D | − | NA |
| 52/DT15 (A) | I108C, D128C | − | NA |
| 56/DT16 (A) | S175C, L177C | − | NA |
| 12/DT4 (A) | I109C, E129C | − | NA |
| 30/DT10 (A) | R129Q, R139Q, G119C, N123A, L156C, R160A | − | NA |
| 42/TIC844 and 44/DT13 (M) | NA | +<br>− | −/(Low)<br>+/(High) |
| 42/TIC844 and 48/DT14 (M) | NA | +<br>+ | −/(Low)<br>−/(High) |
| 42/TIC844 and 52/DT15 (M) | NA | +<br>+ | −/(Low)<br>−/(High) |
| 42/TIC844 and 56/DT16 (M) | NA | +<br>+ | −/(Low)<br>−/(High) |
| 42/TIC844 and 12/DT4 (M) | NA | +<br>+ | −/(Low)<br>−/(High) |
| 42/TIC844 and 30/DT10 (M) | NA | +<br>+ | −/(Low)<br>−/(High) |
| 46/TIC868 and 44/DT13 (M) | NA | +<br>+ | −/(Low)<br>−/(High) |
| 46/TIC868 and 48/DT14 (M) | NA | +<br>− | −/(Low)<br>+/(High) |
| 46/TIC868 and 52/DT15 (M) | NA | +<br>+ | −/(Low)<br>−/(High) |
| 46/TIC868 and 56/DT16 (M) | NA | +<br>+ | −/(Low)<br>−/(High) |
| 46/TIC868 and 12/DT4 (M) | NA | +<br>+ | −/(Low)<br>−/(High) |
| 46/TIC868 and 30/DT10 (M) | NA | +<br>+ | −/(Low)<br>−/(High) |
| 50/TIC842 and 44/DT13 (M) | NA | +<br>+ | −/(Low)<br>−/(High) |
| 50/TIC842 and 48/DT14 (M) | NA | +<br>+ | −/(Low)<br>−/(High) |
| 50/TIC842 and 52/DT15 (M) | NA | +<br>− | −/(Low)<br>+/(High) |
| 54/Vip3A and 44/DT13 (M) | NA | +<br>+ | −/(Low)<br>−/(High) |
| 54/Vip3A and 48/DT14 (M) | NA | +<br>+ | −/(Low)<br>−/(High) |
| 54/Vip3A and 56/DT16 (M) | NA | +<br>− | −/(Low)<br>+/(High) |

Example 10

TABLE 14

Competition Data between Native Protein and Disabled Toxin Counterpart in Soybean Looper Larvae

| SEQ ID NO:/ Cry protein | Amino Acid Sequence Modification | SBL Mortality | Homologous Competition Against the corresponding FFPP Toxin in SBL/ (Challenge Ratio) |
|---|---|---|---|
| 58/TIC1100 | — | + | NA |
| 60/DT17 | E99C, R144C | − | −/(Low) +/(High) |
| 62/TIC867 | — | + | NA |
| 64/DT18 | A160N, N167D | − | −/(Low) +/(High) |

All of the compositions and methods disclosed and claimed herein can be made and executed without undue experimentation in light of the present disclosure. While the compositions and methods of this invention have been described in teens of the foregoing illustrative embodiments, it will be apparent to those of skill in the art that variations, changes, modifications, and alterations may be applied to the composition, methods, and in the steps or in the sequence of steps of the methods described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

It should be apparent to those skilled in the art that these different, sequence variations can be combined to create variants which are also within the scope of this invention.

All publications and published patent documents cited in the specification are incorporated herein by reference to the same extent as if each individual publication or patent application was specifically and individually indicated to be incorporated by reference.

BIBLIOGRAPHY

1. Abrol, D. P. and U. Shankar (2012). *Integrated Pest Management: Principles and Practice*. Cambridge, Mass., CABI.
2. Badran, A. H., V. M. Guzov, Q. Huai, M. M. Kemp, P. Vishwanath, W. Kain, A. M. Nance, A. Evdokimov, F. Moshiri, K. H. Turner, P. Wang, T. Malvar and D. R. Liu (2016). "Continuous evolution of *Bacillus thuringiensis* toxins overcomes insect resistance." *Nature* 533(7601): 58-63.
3. Banks, D. J., J. L. Jurat-Fuentes, D. H. Dean and M. J. Adang (2001). "*Bacillus thuringiensis* Cry1Ac and Cry1Fa delta-endotoxin binding to a novel 110 kDa aminopeptidase in *Heliothis virescens* is not N-acetylgalactosamine mediated." *Insect Biochem Mol Biol* 31(9): 909-918.
4. Bates S. L., Z. J. Z., Roush R. T., Shelton A.M. (2005). "Insect resistance management in GM crops: past, present and future." *Nat Biotechnol.* 23(1): 57-62.
5. Bravo, A., Gomez, I., Porta, H., Garcia-Gomez, B. I., Rodriguez-Almazan, C., Pardo, L., Soberon, M. (2012). "Evolution of *Bacillus thuringiensis* Cry toxins insecticidal activity." *Microb Biotechnol* 6(1): 17-26.
6. Carrière Y., C. N., Tabashnik B. E. (2015). "Optimizing pyramided transgenic Bt crops for sustainable pest management." *Nat Biotechnol.* 33(2): 161-168.
7. Deitloff, J., M. W. Dunbar, D. A. Ingber, B. E. Hibbard and A. J. Gassmann (2016). "Effects of refuges on the evolution of resistance to transgenic corn by the western corn rootworm, *Diabrotica virgifera* virgifera LeConte." *Pest Manag Sci* 72(1): 190.
8. Devos, Y., L. N. Mcihls, J. Kiss and B. E. Hibbard (2013). "Resistance evolution to the first generation of genetically modified Diabrotica-active Bt-maize events by western corn rootworm: management and monitoring considerations." *Transgenic Res* 22(2): 269-299.
9. Estela, A., Escriche, B., Ferre, J. (2004). "Interaction of *Bacillus thuringiensis* Toxins with Larval Midgut Binding Sites of *Helicoverpa armigera* (Lepidoptera: Noctuidae)." *Applied and Environmental Microbiology* 70(3): 1378-1384.
10. Girard, F., V. Vachon, G. Prefontaine, L. Marceau, J. L. Schwartz, L. Masson and R. Laprade (2009). "Helix alpha 4 of the *Bacillus thuringiensis* Cry1Aa toxin plays a critical role in the postbinding steps of pore formation." *Appl Environ Microbiol* 75(2): 359-365.
11. Girard, F., V. Vachon, G. Prefontaine, L. Marceau, Y. Su, G. Larouche, C. Vincent, J. L. Schwartz, L. Masson and R. Laprade (2008). "Cysteine scanning mutagenesis of alpha4, a putative pore-lining helix of the *Bacillus thuringiensis* insecticidal toxin Cry1Aa." *Appl Environ Microbiol* 74(9): 2565-2572.
12. González-Cabrera J., E. B., Tabashnik B. E., Ferré J. (2003). "Binding of *Bacillus thuringiensis* toxins in resistant and susceptible strains of pink bollworm (*Pectinophora gossypiella*)." *Insect Biochemistry and Molecular Biology* 33(9): 929-935.
13. Gowda, A. R., T. J.; Wollacott, A. M.; Brown, R. S.; Akbar, W.; Clark, T. L.; Flasinski, S.; Nageotte, J. R.; Read, A. C.; Shi, X.; Werner, B. J.; Pleau, M. J.; and Baum, J. A. (2016). "A transgenic approach for controlling *Lygus* in cotton." *Nature Communications* 7: 12213.
14. Granero F., B. V., Ferré J. (1996). "*Bacillus thuringiensis* crystal proteins CRY1Ab and CRY1Fa share a high affinity binding site in Plutella xylostella (L.)." *Biochem Biophys Res Commun.* 224(3): 779-783.
15. Herrero, S., B. Oppert and J. Ferre (2001). "Different mechanisms of resistance to *Bacillus thuringiensis* toxins in the indianmeal moth." *Appl Environ Microbiol* 67(3): 1085-1089.
16. Herskowitz, I. (1987). "Functional inactivation of genes by dominant negative mutations." *Nature* 329(6136): 219-222.
17. Jakka, S., Ferré, J., Jurat-Fuentes, J. L. (2015). "Cry toxin binding sites and their use in strategies to delay resistance evolution." *Bt resistance: characterization and strategies for gm crops producing Bacillus thuringiensis toxins; Editors: Soberón, M., Gao, Y.; Bravo, A., CAB International: Boston (MA), USA.* Chapter 13: 138.
18. Jimenez-Juarez, N., C. Munoz-Garay, I. Gomez, G. Saab-Rincon, J. Y. Damian-Almazo, S. S. Gill, M. Soberon and A. Bravo (2007). "*Bacillus thuringiensis* Cry1Ab Mutants Affecting Oligomer Formation Arc Non-toxic to *Manduca sexta* Larvae." *Journal of Biological Chemistry* 282(29): 21222-21229.
19. Jurat-Fuentes, J. L., Crickmore, N. (2017). "Specificity determinants for Cry insecticidal proteins: Insights from their mode of action." *Journal of Invertebrate Pathology* 142: 5-10.

20. Keeton, T. P., B. R. Francis, W. S. Maaty and L. A. Bulla, Jr. (1998). "Effects of midgut-protein-preparative and ligand binding procedures on the toxin binding characteristics of BT-R1, a common high-affinity receptor in *Manduca sexta* for Cry 1A *Bacillus thuringiensis* toxins." *Appl Environ Microbiol* 64(6): 2158-2165.

21. Koch, M. S., Ward, J. M., Levine, S. L., Baum, J. A., Vicini, J. L., and Hammond, B. G. (2015). "The food and environmental safety of Bt crops." *Front Plant Sci* 6: 283.

22. Luo, K., S. Sangadala, L. Masson, A. Mazza, R. Brousseau and M. J. Adang (1997). "The heliothis virescens 170 kDa aminopeptidase functions as "receptor A" by mediating specific *Bacillus thuringiensis* Cry1A delta-endotoxin binding and pore formation." *Insect Biochem Mol Biol* 27(8-9): 735-743.

23. Martin, F. G. and M. G. Wolfersberger (1995). "*Bacillus thuringiensis* delta-endotoxin and larval *Manduca sexta* midgut brush-border membrane vesicles act synergistically to cause very large increases in the conductance of planar lipid bilayers." *J Exp Biol* 198(Pt 1): 91-96.

24. Melo, A. L. S., V. T.; and Soccol, C. R. (2016). "*Bacillus thuringiensis*: mechanism of action, resistance, and new applications: a review." *Crit Rev Biotechnol* 36(2): 317-326.

25. Onofre J., G. M. O., Peña-Cardeña A., García-Gomez B. I., Pacheco S., Gomez I., Bravo A., Soberón M. (2017). "Identification of Aminopeptidase-N2 as a Cry2Ab binding protein in *Manduca sexta*." *Peptides* 98: 93.

26. Pardo-Lopez, L. S., M.; and Bravo, A. (2013). "*Bacillus thuringiensis* insecticidal three-domain Cry toxins: mode of action, insect resistance and consequences for crop protection." *FEMS Microbiol Rev.* 37(1): 3-22.

27. Rodríguez-Almázan C, Z. L., Muñoz-Garay C, Jiménez-Juárez N, Pacheco S, Masson L, Soberón M, Bravo A. (2009). "Dominant Negative Mutants of *Bacillus thuringiensis* Cry1Ab Toxin Function as Anti-Toxins: Demonstration of the Role of Oligomerization in Toxicity." *PLoS One.* 4(5): 5545.

28. Siebert, M. W. N., S. P.; Hendrix, W.; Dhavala, S.; Craig, C.; Leonard, B. R.; Stewart, S. D.; All, J.; Musser, F. R.; Buntin, G. D.; and Samuel, L. (2012). "Evaluation of corn hybrids expressing Cry1F, cry1A.105, Cry2Ab2, Cry34Ab1/Cry35Ab1, and Cry3Bb1 against southern United States insect pests." *J. Econ. Entomol.* 105(5): 1825-1834.

29. Siqueira, H. A. A., D. Moellenbeck, T. Spencer and B. D. Siegfried (2004). "Cross-Resistance of Cry1Ab-Selected *Ostrinia nubilalis* (Lepidoptera: Crambidae) to *Bacillus thuringiensis* δ-Endotoxins." *Journal of Economic Entomology* 97(3): 1049-1057.

30. Tabashnik B. E., L. Y. B., de Maagd R. A., Dennehy T. J. (2000). "Cross-resistance of pink bollworm (*Pectinophora gossypiella*) to *Bacillus thuringiensis* toxins." *Appl Environ Microbiol.* 66(10): 4582-4584.

31. Tabashnik B. E., L. Y. B., Malvar T., Heckel D. G., Masson L., Ballester V., Granero F., Ménsua J. L., Fence J. (1997). "Global variation in the genetic and biochemical basis of diamondback moth resistance to *Bacillus thuringiensis.*" *Proc Natl Acad Sci* 94(24): 12780-12785.

32. Tabashnik, B. E. (2010). "Communal benefits of transgenic corn." *Science* 330(6001): 189-190.

33. Tabashnik, B. E. B., T.; and Carriere, Y. (2013). "Insect resistance to Bt crops: lessons from the first billion acres." *Nat Biotechnol* 31(6): 510-521.

34. Tabashnik, B. E., K. W. Johnson, J. T. Engleman and J. A. Baum (2000). "Cross-Resistance to *Bacillus thuringiensis* Toxin Cry1Ja in a Strain of Diamondback Moth Adapted to Artificial Diet." *Journal of Invertebrate Pathology* 76(1): 81-83.

35. Tanaka, S., Miyamoto, K., Noda, H., Jurat-Fuentes, J. L., Yoshizawa, Y., Endo, H., Sato, R. (2013). "The ATP-binding cassette transporter subfamily C member 2 in *Bombyx mori* larvae is a functional receptor for Cry toxins from *Bacillus thuringiensis.*" *FEBS J* 280(8): 1782-1794.

36. Vachon, V. L., R.; and Schwartz, J. L. (2012). "Current models of the mode of action of *Bacillus thuringiensis* insecticidal crystal proteins: a critical review." *J. Invertebr. Pathol.* 111(1): 1-12.

37. Vachon, V., G. Prefontaine, C. Rang, F. Coux, M. Juteau, J. L. Schwartz, R. Brousseau, R. Frutos, R. Laprade and L. Masson (2004). "Helix 4 Mutants of the *Bacillus thuringiensis* Insecticidal Toxin Cry1Aa Display Altered Pore-Forming Abilities." *Applied and Environmental Microbiology* 70(10): 6123-6130.

38. Zhao J. Z., C. J., Li Y., Collins H. L., Roush R. T., Earle E. D., Shelton A. M. (2003). "Transgenic plants expressing two *Bacillus thuringiensis* toxins delay insect resistance evolution." *Nat Biotechnol.* 21(12): 1493-1497.

---

SEQUENCE LISTING (64 sequences)

SEQ ID NO: 1 - DNA, 3468 bp, Bacillus thuringiensis
  CDS (1)..(3468)
  misc_feature (1)..(3468): Pesticidal protein Cry1Ab.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattccttcatcacaaattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaataa

SEQ ID NO: 2 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 3 - DNA, 3468 bp, Artificial
  Disabled toxin DT1.
  CDS (1)..(3468)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctgaattagaaggactaagcaatctttatcaaatttacgcagaatcttttagagagtgggaagcagatcctactaatccagcattaagagaagagatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattccttcatcacaaattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaataa

SEQ ID NO: 4 - protein, 1155 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISELEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 5 - DNA, 3468 bp, Artificial
  Disabled toxin DT2.
  CDS (1)..(3468)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaaaagatgcgtattcaattcaataacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattccttcatcacaaattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaataa

SEQ ID NO: 6 - protein, 1155 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREKMRIQFNNMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 7 - DNA, 3468 bp, Artificial
  Disabled toxin DT3.
  CDS (1)..(3468)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaatgttacgcagaatcttttagagagtgggaagcagatcctactaatccagcattaagagaatgtatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattccttcatcacaaattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaataa

SEQ ID NO: 8 - protein, 1155 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQCYAESFREWEADPTNPALRECMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 9 - DNA, 3534 bp, Artificial
  Pesticidal protein TIC105.
  CDS (1)..(3534)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacactcgaggctgaatataatctggaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctattccattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 10 - protein, 1177 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYSIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 11 - DNA, 3534 bp, Artificial
  Disabled toxin DT4.
  CDS (1)..(3534)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaatgttacgcagaatcttttagagagtgggaagcagatcctactaatccagcattaagagaatgtatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacactcgaggctgaatataatctggaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctattccattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 12 - protein, 1177 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQCYAESFREWEADPTNPALRECMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYSIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 13 - DNA, 3537 bp, Artificial
  Pesticidal protein TIC107.
  CDS (1)..(3537)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattccagttactgcaacactcgaggctgaatataatctggaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctattccattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 14 - protein, 1178 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYSIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 15 - DNA, 3537 bp, Artificial
  Disabled toxin DT5.
  CDS (1)..(3537)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaatgttacgcagaatcttttagagagtgggaagcagatcctactaatccagcattaagagaatgtatgcgtattcaattcaatgacatgaacagtgcccttacaaccgctattcctctttttgcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagatcatgctgtacgctggtacaatacgggattagagcgtgtatggggaccggattctagagattggataagatataatcaatttagaagagaattaacactaactgtattagatatcgtttctctatttccgaactatgatagtagaacgtatccaattcgaacagtttcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggttttcggggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattccagttactgcaacactcgaggctgaatataatctggaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctattccattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 16 - protein, 1178 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQCYAESFREWEADPTNPALRECMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYSIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 17 - DNA, 1902 bp, Bacillus thuringiensis
  CDS (1)..(1902)
  misc_feature (1)..(1902): Pesticidal protein Cry2Ab.
atgaatagtgtattgaatagcggaagaactactatttgtgatgcgtataatgtagcggctcatgatccatttagttttcaacacaaatcattagataccgtacaaaaggaatggacggagtggaaaaaaaataatcatagtttatacctagatcctattgttggaactgtggctagttttctgttaaagaaagtggggagtcttgttggaaaaaggatactaagtgagttacggaatttaatatttcctagtggtagtacaaatctaatgcaagatattttaagagagacagaaaaattcctgaatcaaagacttaatacagacactcttgcccgtgtaaatgcggaattgacagggctgcaagcaaatgtagaagagtttaatcgacaagtagataattttttgaaccctaaccgaaacgctgttcctttatcaataacttcttcagttaatacaatgcaacaattatttctaaatagattaccccagttccagatgcaaggataccaactgttattattacctttatttgcacaggcagccaatttacatctttcttttattagagatgttattctaaatgcagatgaatggggaatttcagcagcaacattacgtacgtatcgagattacttgaaaaattatacaagagattactctaactattgtataaatacgtatcaaagtgcgtttaaaggtttaaacactcgtttacacgatatgttagaatttagaacatatatgtttttaaatgtatttgagtatgtatctatctggtcgttgtttaaatatcaaagtcttctagtatcttccggtgctaatttatatgcaagtggtagtggaccacagcagacccaatcatttacttcacaagactggccatttttatattctcttttccaagttaattcaaattatgtgttaaatggatttagtggtgctaggctttctaataccttccctaatatagttggtttacctggttctactacaactcacgcattgcttgctgcaagggttaattacagtggaggaatttcgtctggtgatataggtgcatctccgtttaatcaaaattttaattgtagcacatttctccccccattgttaacgccatttgttaggagttggctagattcaggttcagatcgggagggcgttgccaccgttacaaattggcaaacagaatcctttgagacaactttagggttaaggagtggtgcttttacagctcgcggtaattcaaactatttcccagattattttattcgtaatatttctggagttcctttagttgttagaaatgaagatttaagaagaccgttacactataatgaaataagaaatatagcaagtccttcaggaacacctggtggagcacgagcttatatggtatctgtgcataacagaaaaaataatatccatgctgttcatgaaaatggttctatgattcatttagcgccaaatgactatacaggatttactatttcgccgatacatgcaactcaagtgaataatcaaacacgaacatttatttctgaaaaatttggaaatcaaggtgattctttaaggtttgaacaaaacaacacgacagctcgttatacgcttagagggaatggaaatagttacaatctttatttaagagtttcttcaataggaaattccactattcgagttactataaacggtagggtatatactgctacaaatgttaatactactacaaataacgatggagttaatgataatggagctcgtttttcagatattaatatcggtaatgtagtagcaagtagtaattctgatgtaccattagatataaatgtaacattaaactccggtactcaatttgatcttatgaatattatgcttgtaccaactaatatttcaccactttattaa

SEQ ID NO: 18 - protein, 633 aa, Bacillus thuringiensis
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 19 - DNA, 921 bp, Artificial
  Pesticidal protein beta-FFPP.
  CDS (1)..(921)
atggcaattttagatcttaaaagtttagtacttaatgcaataaattattggggacctaaaaataataatggaattcaaggaggtgattttggatatccaataagtgaaaaacaaatagatactagtataattactagtacacatcctagattaattccacatgatttaacaattccacaaaatttagaaacaatttttacaactacacaagtattaacaaataatacagatttacaacagagtcaaacagtaagttttgcaaaaaagacaactacaactacagcaacaagtacaactaatggatggacagaaggaggtaaaatttctgatacacttgaagagaaagtaagcgtaagcattccatttattggagaaggaggtggaaaaaatagcacaactattgaagcaaattttgcacataattcttcaacaactacatctcaagaagcttctactgatattgaatggaatatttctcaaccagtactagtaccacctagaaaacaagttgtggctactctagttattatgggtgggaattttactataccaatggatctaatgactacgatagattctactgaacattattctggttatccaatattgacgtggatatcttcacctgataattcatattctggtcgttttatgtcatggtatttcgctaattggcctaatttgccgtcagggttcgggccgttgaattcagacaacacggttacgtatacggggtccgttgtgtcccaagtttccgctggcgtgtatgctacggtcaggttcgaccagtacgacatccataacctgtggaccatcgagaaaacctggtacgcgcgacatgcgaccctccacaacggcaaaaagatctcgatcaacaacgtcaccgagatggccccgacctcgcccatcaagaccaactaa

SEQ ID NO: 20 - protein, 306 aa, Artificial
  Synthetic Construct
MAILDLKSLVLNAINYWGPKNNNGIQGGDFGYPISEKQIDTSIITSTHPRLIPHDLTIPQNLETIFTTTQVLTNNTDLQQSQTVSFAKKTTTTTATSTTNGWTEGGKISDTLEEKVSVSIPFIGEGGGKNSTTIEANFAHNSSTTTSQEASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVVSQVSAGVYATVRFDQYDIHNLWTIEKTWYARHATLHNGKKISINNVTEMAPTSPIKTN

SEQ ID NO: 21 - DNA, 921 bp, Artificial
  Disabled toxin DT6.
  CDS (1)..(921)
atggcaattttagatcttaaaagtttagtacttaatgcaataaattattggggacctaaaaataataatggaattcaaggaggtgattttggatatccaataagtgaaaaacaaatagatactagtataattactagtacacatcctagattaattccacattgcttaacaattccacaaaatttagaaacaatttttacaactacacaagtattaacaaataatacagatttacaacagagtcaaacagtaagttttgcaaaaaagacaactacaactacagcaacaagtacaactaatggatggacagaaggaggtaaaatttctgatacacttgaagagaaagtatgcgtaagcattccatttattggagaaggaggtggaaaaaatagcacaactattgaagcaaattttgcacataattcttcaacaactacagcacaacaggcttctactgatattgaatggaatatttctcaaccagtactagtaccacctagaaaacaagttgtggctactctagttattatgggtgggaattttactataccaatggatctaatgactacgatagattctactgaacattattctggttatccaatattgacgtggatatcttcacctgataattcatattctggtcgttttatgtcatggtatttcgctaattggcctaatttgccgtcagggttcgggccgttgaattcagacaacacggttacgtatacggggtccgttgcatcccaagtttccgctggcgtgtatgctacggtcaggttcgaccagtacgacatccataacctgcgtaccatcgagaaaacctggtacgcgcgacatgcgaccctccacaacggcaaaaagatctcgatcaacaacgtcaccgagatggccccgacctcgcccatcaagaccaactaa

SEQ ID NO: 22 - protein, 306 aa, Artificial
  Synthetic Construct
MAILDLKSLVLNAINYWGPKNNNGIQGGDFGYPISEKQIDTSIITSTHPRLIPHCLTIPQNLETIFTTTQVLTNNTDLQQSQTVSFAKKTTTTTATSTTNGWTEGGKISDTLEEKVCVSIPFIGEGGGKNSTTIEANFAHNSSTTTAQQASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVASQVSAGVYATVRFDQYDIHNLRTIEKTWYARHATLHNGKKISINNVTEMAPTSPIKTN

SEQ ID NO: 23 - DNA, 921 bp, Artificial
  Disabled toxin DT7.
  CDS (1)..(921)
atggcaattttagatcttaaaagtttagtacttaatgcaataaattattggggacctaaaaataataatggaattcaaggaggtgattttggatatccaataagtgaaaaacaaatagatactagtataattactagtacacatcctagattaattccacattgcttaacaattccacaaaatttagaaacaatttttacaactacacaagtattaacaaataatacagatttacaacagagtcaaacagtaagttttgcaaaaaagacaactacaactacagcaacaagtacaactaatggatggacagaaggaggtaaaatttctgatacacttgaagagaaagtaagcgtaagcattccatttattggagaaggaggtggaaaaaattgcacaactattgaagcaaattttgcacataattcttcaacaactacagcacaacaggcttctactgatattgaatggaatatttctcaaccagtactagtaccacctagaaaacaagttgtggctactctagttattatgggtgggaattttactataccaatggatctaatgactacgatagattctactgaacattattctggttatccaatattgacgtggatatcttcacctgataattcatattctggtcgttttatgtcatggtatttcgctaattggcctaatttgccgtcagggttcgggccgttgaattcagacaacacggttacgtatacggggtccgttgcatcccaagtttccgctggcgtgtatgctacggtcaggttcgaccagtacgacatccataacctgcgtaccatcgagaaaacctggtacgcgcgacatgcgaccctccacaacggcaaaaagatctcgatcaacaacgtcaccgagatggccccgacctcgcccatcaagaccaactaa

SEQ ID NO: 24 - protein, 306 aa, Artificial
  Synthetic Construct
MAILDLKSLVLNAINYWGPKNNNGIQGGDFGYPISEKQIDTSIITSTHPRLIPHCLTIPQNLETIFTTTQVLTNNTDLQQSQTVSFAKKTTTTTATSTTNGWTEGGKISDTLEEKVSVSIPFIGEGGGKNCTTIEANFAHNSSTTTAQQASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVASQVSAGVYATVRFDQYDIHNLRTIEKTWYARHATLHNGKKISINNVTEMAPTSPIKTN

SEQ ID NO: 25 - DNA, 921 bp, Artificial
  Disabled toxin DT8.
  CDS (1)..(921)
atggcaattttagatcttaaaagtttagtacttaatgcaataaattattggggacctaaaaataataatggaattcaaggaggtgattttggatatccaataagtgaaaaacaaatagatactagtataattactagtacacatcctagattaattccacatgatttaacaattccacaaaatttagaaacaatttttacaactacacaagtattaacaaataatacagatttacaacagagtcaaacagtaagttttgcaaaaaagacaactacaactacagcaacaagtacaactaatggatggacagaaggaggtaaaatttctgatacacttgaagagaaagtaagcgtaagcatttgctttattggagaaggaggtggatgcaatagcacaactattgaagcaaattttgcacataattcttcaacaactacagcacaacaggcttctactgatattgaatggaatatttctcaaccagtactagtaccacctagaaaacaagttgtggctactctagttattatgggtgggaattttactataccaatggatctaatgactacgatagattctactgaacattattctggttatccaatattgacgtggatatcttcacctgataattcatattctggtcgttttatgtcatggtatttcgctaattggcctaatttgccgtcagggttcgggccgttgaattcagacaacacggttacgtatacggggtccgttgcatcccaagtttccgctggcgtgtatgctacggtcaggttcgaccagtacgacatccataacctgcgtaccatcgagaaaacctggtacgcgcgacatgcgaccctccacaacggcaaaaagatctcgatcaacaacgtcaccgagatggccccgacctcgcccatcaagaccaactaa

SEQ ID NO: 26 - protein, 306 aa, Artificial
  Synthetic Construct
MAILDLKSLVLNAINYWGPKNNNGIQGGDFGYPISEKQIDTSIITSTHPRLIPHDLTIPQNLETIFTTTQVLTNNTDLQQSQTVSFAKKTTTTTATSTTNGWTEGGKISDTLEEKVSVSICFIGEGGGCNSTTIEANFAHNSSTTTAQQASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVASQVSAGVYATVRFDQYDIHNLRTIEKTWYARHATLHNGKKISINNVTEMAPTSPIKTN

SEQ ID NO: 27 - DNA, 921 bp, Artificial
  Disabled toxin DT9.
  CDS (1)..(921)
atggcaattttagatcttaaaagtttagtacttaatgcaataaattattggggacctaaaaataataatggaattcaaggaggtgattttggatatccaataagtgaaaaacaaatagatactagtataattactagtacacatcctagattaattccacatgatttaacaattccacaaaatttagaaacaatttttacaactacacaagtattaacaaataatacagatttacaacagagtcaaacagtaagttttgcaaaaaagacaactacaactacagcaacaagtacaactaatggatggacagaaggaggtaaaatttctgatacacttgaagagaaagtaagcgtaagcatttgctttattggagaaggaggtggaaaaaatagcacatgcattgaagcaaattttgcacataattcttcaacaactacagcacaacaggcttctactgatattgaatggaatatttctcaaccagtactagtaccacctagaaaacaagttgtggctactctagttattatgggtgggaattttactataccaatggatctaatgactacgatagattctactgaacattattctggttatccaatattgacgtggatatcttcacctgataattcatattctggtcgttttatgtcatggtatttcgctaattggcctaatttgccgtcagggttcgggccgttgaattcagacaacacggttacgtatacggggtccgttgcatcccaagtttccgctggcgtgtatgctacggtcaggttcgaccagtacgacatccataacctgcgtaccatcgagaaaacctggtacgcgcgacatgcgaccctccacaacggcaaaaagatctcgatcaacaacgtcaccgagatggccccgacctcgcccatcaagaccaactaa

SEQ ID NO: 28 - protein, 306 aa, Artificial
  Synthetic Construct
MAILDLKSLVLNAINYWGPKNNNGIQGGDFGYPISEKQIDTSIITSTHPRLIPHDLTIPQNLETIFTTTQVLTNNTDLQQSQTVSFAKKTTTTTATSTTNGWTEGGKISDTLEEKVSVSICFIGEGGGKNSTCIEANFAHNSSTTTAQQASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVASQVSAGVYATVRFDQYDIHNLRTIEKTWYARHATLHNGKKISINNVTEMAPTSPIKTN

SEQ ID NO: 29 - DNA, 1902 bp, Artificial
  Disabled toxin DT10.
  CDS (1)..(1902)
atgaatagtgtattgaatagcggaagaactactatttgtgatgcgtataatgtagcggctcatgatccatttagttttcaacacaaatcattagataccgtacaaaaggaatggacggagtggaaaaaaaataatcatagtttatacctagatcctattgttggaactgtggctagttttctgttaaagaaagtggggagtcttgttggaaaaaggatactaagtgagttacggaatttaatatttcctagtggtagtacaaatctaatgcaagatattttaagagagacagaaaaattcctgaatcaaagacttaatacagacactcttgcccgtgtaaatgcggaattgacatgtctgcaagcagcagtagaagagtttaatcagcaagtagataacttcctgaaccctaaccagaacgctgttcctttatcaataacttcttcagttaatacaatgcaacaatgttttctaaatgcattaccccagttccagatgcaaggataccaactgttattattacctttatttgcacaggcagccaatttacatctttcttttattagagatgttattctaaatgcagatgaatggggaatttcagcagcaacattacgtacgtatcgagattacttgaaaaattatacaagagattactctaactattgtataaatacgtatcaaagtgcgtttaaaggtttaaacactcgtttacacgatatgttagaatttagaacatatatgtttttaaatgtatttgagtatgtatctatctggtcgttgtttaaatatcaaagtcttctagtatcttccggtgctaatttatatgcaagtggtagtggaccacagcagacccaatcatttacttcacaagactggccatttttatattctcttttccaagttaattcaaattatgtgttaaatggatttagtggtgctaggctttctaataccttccctaatatagttggtttacctggttctactacaactcacgcattgcttgctgcaagggttaattacagtggaggaatttcgtctggtgatataggtgcatctccgtttaatcaaaattttaattgtagcacatttctccccccattgttaacgccatttgttaggagttggctagattcaggttcagatcgggagggcgttgccaccgttacaaattggcaaacagaatcctttgagacaactttagggttaaggagtggtgcttttacagctcgcggtaattcaaactatttcccagattattttattcgtaatatttctggagttcctttagttgttagaaatgaagatttaagaagaccgttacactataatgaaataagaaatatagcaagtccttcaggaacacctggtggagcacgagcttatatggtatctgtgcataacagaaaaaataatatccatgctgttcatgaaaatggttctatgattcatttagcgccaaatgactatacaggatttactatttcgccgatacatgcaactcaagtgaataatcaaacacgaacatttatttctgaaaaatttggaaatcaaggtgattctttaaggtttgaacaaaacaacacgacagctcgttatacgcttagagggaatggaaatagttacaatctttatttaagagtttcttcaataggaaattccactattcgagttactataaacggtagggtatatactgctacaaatgttaatactactacaaataacgatggagttaatgataatggagctcgtttttcagatattaatatcggtaatgtagtagcaagtagtaattctgatgtaccattagatataaatgtaacattaaactccggtactcaatttgatcttatgaatattatgcttgtaccaactaatatttcaccactttattaa

SEQ ID NO: 30 - protein, 633 aa, Artificial
  Synthetic Construct
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTCLQAAVEEFNQQVDNFLNPNQNAVPLSITSSVNTMQQCFLNALPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 31 - DNA, 921 bp, Artificial
  Pesticidal protein beta-FFPP-2
  CDS (1)..(921)
atggctatcctagaccttaagtccctcgtgctgaacgccattaactactggggccctaagaacaacaacggcatccagggcggtgacttcggctaccccatctctgagaagcagatcgacactagcatcattacctccacccaccctcgcttgatcccccacgatcttactatcccgcagaaccttgagaccatcttcaccacaacgcaggtgctcaccaataacactgacctccagcaatcccagaccgtgagctttgcgaagaagaccactaccacgaccgcaactagcacgaccaacggttggacagaaggaggcaagatcagcgacacgctggaggagaaagtttcggttagcattccgttcatcggtgagggtggcgggaagaactcgactaccatagaggccaacttcgcacacaactctagcaccactaccgcccagcaagcaagcactgacattgagtggaacattagccaaccggtccttgtgcctccccgcaaacaggttgttgccactctcgttatcatgggtggcaacttcactattcctatggatcttatgactaccattgactctactgagcactactctggctaccccattctcacttggatctcttctcctgacaatagctacagcggtcgattcatgtcatggtacttcgctaactggccgaatctcccttctggctttggtcctcttaactctgataacactgtgacctacactggctctgtcgccagtcaggtctctgccggtgtgtacgcaactgttcgcttcgatcagtatgacatccataatctcaggactattgagaagacctggtacgctcgtcatgcgacgcttcacaacggcaagaagatcagcatcaataacgtgacagaaatggcccctaccagcccgatcaagactaactga

SEQ ID NO: 32 - protein, 306 aa, Artificial
  Synthetic Construct
MAILDLKSLVLNAINYWGPKNNNGIQGGDFGYPISEKQIDTSIITSTHPRLIPHDLTIPQNLETIFTTTQVLTNNTDLQQSQTVSFAKKTTTTTATSTTNGWTEGGKISDTLEEKVSVSIPFIGEGGGKNSTTIEANFAHNSSTTTAQQASTDIEWNISQPVLVPPRKQVVATLVIMGGNFTIPMDLMTTIDSTEHYSGYPILTWISSPDNSYSGRFMSWYFANWPNLPSGFGPLNSDNTVTYTGSVASQVSAGVYATVRFDQYDIHNLRTIEKTWYARHATLHNGKKISINNVTEMAPTSPIKTN

SEQ ID NO: 33 - DNA, 3534 bp, Artificial
  Pesticidal protein BCW003.
  CDS (1)..(3534)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacgaacccagtattagaaaattttgatggtagttttcgtggaatggctcagagaatagaacagaatattaggcaaccacatcttatggatatccttaatagtataaccatttatactgatgtgcatagaggctttaattattggtcagggcatcaaataacagcttctcctgtagggttttcaggaccagaattcgcattccctttatttgggaatgcgggaaatgcagctccacccgtacttgtctcattaactggtttggggatttttagaacattatcttcacctttatatagaagaattatacttggttcaggcccaaataatcaggaactgtttgtccttgatggaacggagttttcttttgcctccctaacgaccaacttgccttccactatatatagacaaaggggtacagtcgattcactagatgtaataccgccacaggataatagtgtaccacctcgtgcgggatttagccatcgattgagtcatgttacaatgctgagccaagcagctggagcagtttacaccttgagagctccaacgttttcttggcagcatcgcagtgctacgacaactaatataattgcagcggatagtattactcaaattcctgctgttaaaggacgttctattattaataatggcacggtaatttcaggaccagggtttaccggaggcgatttggttagattatacaatgctgattttaatattaataatagagcataccttgaagttccgatattcttccaatcaccctctacaaattatcgtgttcgtgttcgttatgcttctacatcttcactccctgtagatgtagttttcggaaatattagtcatcctactacattcccagccactgccagatcattagataatctacaatccaatgattttggatatattgatattgctggaactttcttaccttcactagggcctagtataggtatcagacctatgttatctactattaatttgatagtagatagatttgaatttattccagtaactgcaacctttgaagcagaatcggatttagaaagagcacaaaaggcggtgaatgcgctgtttacttctacaaaccaactagggataaaaacagatgtgacggattatcatattgatcaagtgtccaatttagtggagtgtttatcggatgaattttatctggatgaaaagcgagaattgtccgagaaagtcaaacatgcgaagcgactcagtgatgagcgaaatttacttcaagatccaaacttcaggggcatcaatagacaaccagatcgtggctggagaggaagtacggatattaccatccaaggaggagatgacgtattcaaagagaattacgtcacactaccaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcactagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 34 - protein, 1177 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSATTTNIIAADSITQIPAVKGRSIINNGTVISGPGFTGGDLVRLYNADFNINNRAYLEVPIFFQSPSTNYRVRVRYASTSSLPVDVVFGNISHPTTFPATARSLDNLQSNDFGYIDIAGTFLPSLGPSIGIRPMLSTINLIVDRFEFIPVTATFEAESDLERAQKAVNALFTSTNQLGIKTDVTDYHIDQVSNLVECLSDEFYLDEKRELSEKVKHAKRLSDERNLLQDPNFRGINRQPDRGWRGSTDITIQGGDDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 35 - DNA, 3534 bp, Artificial
  Disabled toxin DT11.
  CDS (1)..(3534)
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaatgttacgcagaatcttttagagagtgggaagcagatcctactaatccagcattaagagaatgtatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacgaacccagtattagaaaattttgatggtagttttcgtggaatggctcagagaatagaacagaatattaggcaaccacatcttatggatatccttaatagtataaccatttatactgatgtgcatagaggctttaattattggtcagggcatcaaataacagcttctcctgtagggttttcaggaccagaattcgcattccctttatttgggaatgcgggaaatgcagctccacccgtacttgtctcattaactggtttggggatttttagaacattatcttcacctttatatagaagaattatacttggttcaggcccaaataatcaggaactgtttgtccttgatggaacggagttttcttttgcctccctaacgaccaacttgccttccactatatatagacaaaggggtacagtcgattcactagatgtaataccgccacaggataatagtgtaccacctcgtgcgggatttagccatcgattgagtcatgttacaatgctgagccaagcagctggagcagtttacaccttgagagctccaacgttttcttggcagcatcgcagtgctacgacaactaatataattgcagcggatagtattactcaaattcctgctgttaaaggacgttctattattaataatggcacggtaatttcaggaccagggtttaccggaggcgatttggttagattatacaatgctgattttaatattaataatagagcataccttgaagttccgatattcttccaatcaccctctacaaattatcgtgttcgtgttcgttatgcttctacatcttcactccctgtagatgtagttttcggaaatattagtcatcctactacattcccagccactgccagatcattagataatctacaatccaatgattttggatatattgatattgctggaactttcttaccttcactagggcctagtataggtatcagacctatgttatctactattaatttgatagtagatagatttgaatttattccagtaactgcaacctttgaagcagaatcggatttagaaagagcacaaaaggcggtgaatgcgctgtttacttctacaaaccaactagggataaaaacagatgtgacggattatcatattgatcaagtgtccaatttagtggagtgtttatcggatgaattttatctggatgaaaagcgagaattgtccgagaaagtcaaacatgcgaagcgactcagtgatgagcgaaatttacttcaagatccaaacttcaggggcatcaatagacaaccagatcgtggctggagaggaagtacggatattaccatccaaggaggagatgacgtattcaaagagaattacgtcacactaccaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcactagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 36 - protein, 1177 aa, Artificial
  Synthetic Construct
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQCYAESFREWEADPTNPALRECMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSATTTNIIAADSITQIPAVKGRSIINNGTVISGPGFTGGDLVRLYNADFNINNRAYLEVPIFFQSPSTNYRVRVRYASTSSLPVDVVFGNISHPTTFPATARSLDNLQSNDFGYIDIAGTFLPSLGPSIGIRPMLSTINLIVDRFEFIPVTATFEAESDLERAQKAVNALFTSTNQLGIKTDVTDYHIDQVSNLVECLSDEFYLDEKRELSEKVKHAKRLSDERNLLQDPNFRGINRQPDRGWRGSTDITIQGGDDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 37 - DNA, 3570 bp, Bacillus thuringiensis
  CDS (1)..(3570)
  misc_feature (1)..(3570): Pesticidal protein Cry1Ca.
atggaggaaaataatcaaaatcaatgcataccttacaattgtttaagtaatcctgaagaagtacttttggatggagaacggatatcaactggtaattcatcaattgatatttctctgtcacttgttcagtttctggtatctaactttgtaccagggggaggatttttagttggattaatagattttgtatggggaatagttggcccttctcaatgggatgcatttctagtacaaattgaacaattaattaatgaaagaatagctgaatttgctaggaatgctgctattgctaatttagaaggattaggaaacaatttcaatatatatgtggaagcatttaaagaatgggaagaagatcctaataatccagcaaccaggaccagagtaattgatcgctttcgtatacttgatgggctacttgaaagggacattccttcgtttgcaatttctggatttgaagtaccccttttatccgtttatgctcaagcggccaatctgcatctagctatattaagagattctgtaatttttggagaaagatggggattgacaacgataaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcagccagttggtcaactaacaagggaagtttatacggacccattaattaattttaatccacagttacagtctgtagctcaattacctacttttaacgttatggagagcagcgcaattagaaatcctcatttatttgatatattgaataatcttacaatctttacggattggtttagtgttggacgcaatttttattggggaggacatcgagtaatatctagccttataggaggtggtaacataacatctcctatatatggaagagaggcgaaccaggagcctccaagatcctttacttttaatggaccggtatttaggactttatcaaatcctactttacgattattacagcaaccttggccagcgccaccatttaatttacgtggtgttgaaggagtagaattttctacacctacaaatagctttacgtatcgaggaagaggtacggttgattctttaactgaattaccgcctgaggataatagtgtgccacctcgcgaaggatatagtcatcgtttatgtcatgcaacttttgttcaaagatctggaacaccttttttaacaactggtgtagtattttcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgccctgtttacttcttccaatcaaatcgggttaaaaaccgatgtgacggattatcatattgatcaagtatccaatttagtggattgtttatcagatgaattttgtctggatgaaaagcgagaattgtccgagaaagtcaaacatgcgaagcgactcagtgatgagcggaatttacttcaagatccaaacttcagagggatcaatagacaaccagaccgtggctggagaggaagtacagatattaccatccaaggaggagatgacgtattcaaagagaattacgtcacactaccgggtaccgttgatgagtgctatccaacgtatttatatcagaaaatagatgagtcgaaattaaaagcttatacccgttatgaattaagagggtatatcgaagatagtcaagacttagaaatctatttgatccgttacaatgcaaaacacgaaatagtaaatgtgccaggcacgggttccttatggccgctttcagcccaaagtccaatcggaaagtgtggagaaccgaatcgatgcgcgccacaccttgaatggaatcctgatctagattgttcctgcagagacggggaaaaatgtgcacatcattcccatcatttcaccttggatattgatgttggatgtacagacttaaatgaggacttaggtgtatgggtgatattcaagattaagacgcaagatggccatgcaagactagggaatctagagtttctcgaagagaaaccattattaggggaagcactagctcgtgtgaaaagagcggagaagaagtggagagacaaacgagagaaactgcagttggaaacaaatattgtttataaagaggcaaaagaatctgtagatgctttatttgtaaactctcaatatgatagattacaagtggatacgaacatcgcaatgattcatgcggcagataaacgcgttcatagaatccgggaagcgtatctgccagagttgtctgtgattccaggtgtcaatgcggccattttcgaagaattagagggacgtatttttacagcgtattccttatatgatgcgagaaatgtcattaaaaatggcgatttcaataatggcttattatgctggaacgtgaaaggtcatgtagatgtagaagagcaaaacaaccaccgttcggtccttgttatcccagaatgggaggcagaagtgtcacaagaggttcgtgtctgtccaggtcgtggctatatccttcgtgtcacagcatataaagagggatatggagagggctgcgtaacgatccatgagatcgaagacaatacagacgaactgaaattcagcaactgtgtagaagaggaagtatatccaaacaacacagtaacgtgtaataattatactgggactcaagaagaatatgagggtacgtacacttctcgtaatcaaggatatgacgaagcctatggtaataacccttccgtaccagctgattacgcttcagtctatgaagaaaaatcgtatacagatggacgaagagagaatccttgtgaatctaacagaggctatggggattacacaccactaccggctggttatgtaacaaaggatttagagtacttcccagagaccgataaggtatggattgagatcggagaaacagaaggaacattcatcgtggatagcgtggaattactccttatggaggaataa

SEQ ID NO: 38 - protein, 1189 aa, Bacillus thuringiensis
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFAISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 39 - DNA, 3570 bp, Artificial
  Disabled toxin DT12.
  CDS (1)..(3570)
atggaggaaaataatcaaaatcaatgcataccttacaattgtttaagtaatcctgaagaagtacttttggatggagaacggatatcaactggtaattcatcaattgatatttctctgtcacttgttcagtttctggtatctaactttgtaccagggggaggatttttagttggattaatagattttgtatggggaatagttggcccttctcaatgggatgcatttctagtacaaattgaacaattaattaatgaaagaatagctgaatttgctaggaatgctgctattgcttgtttagaaggattaggaaacaatttcaatatatatgtggaagcatttaaagaatgggaagaagatcctaataatccagcaaccaggaccagagtaattgatcgctttcgtatacttgatgggctacttgaaaggtgtattccttcgtttgcaatttctggatttgaagtaccccttttatccgtttatgctcaagcggccaatctgcatctagctatattaagagattctgtaatttttggagaaagatggggattgacaacgataaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcagccagttggtcaactaacaagggaagtttatacggacccattaattaattttaatccacagttacagtctgtagctcaattacctacttttaacgttatggagagcagcgcaattagaaatcctcatttatttgatatattgaataatcttacaatctttacggattggtttagtgttggacgcaatttttattggggaggacatcgagtaatatctagccttataggaggtggtaacataacatctcctatatatggaagagaggcgaaccaggagcctccaagatcctttacttttaatggaccggtatttaggactttatcaaatcctactttacgattattacagcaaccttggccagcgccaccatttaatttacgtggtgttgaaggagtagaattttctacacctacaaatagctttacgtatcgaggaagaggtacggttgattctttaactgaattaccgcctgaggataatagtgtgccacctcgcgaaggatatagtcatcgtttatgtcatgcaacttttgttcaaagatctggaacaccttttttaacaactggtgtagtattttcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgccctgtttacttcttccaatcaaatcgggttaaaaaccgatgtgacggattatcatattgatcaagtatccaatttagtggattgtttatcagatgaattttgtctggatgaaaagcgagaattgtccgagaaagtcaaacatgcgaagcgactcagtgatgagcggaatttacttcaagatccaaacttcagagggatcaatagacaaccagaccgtggctggagaggaagtacagatattaccatccaaggaggagatgacgtattcaaagagaattacgtcacactaccgggtaccgttgatgagtgctatccaacgtatttatatcagaaaatagatgagtcgaaattaaaagcttatacccgttatgaattaagagggtatatcgaagatagtcaagacttagaaatctatttgatccgttacaatgcaaaacacgaaatagtaaatgtgccaggcacgggttccttatggccgctttcagcccaaagtccaatcggaaagtgtggagaaccgaatcgatgcgcgccacaccttgaatggaatcctgatctagattgttcctgcagagacggggaaaaatgtgcacatcattcccatcatttcaccttggatattgatgttggatgtacagacttaaatgaggacttaggtgtatgggtgatattcaagattaagacgcaagatggccatgcaagactagggaatctagagtttctcgaagagaaaccattattaggggaagcactagctcgtgtgaaaagagcggagaagaagtggagagacaaacgagagaaactgcagttggaaacaaatattgtttataaagaggcaaaagaatctgtagatgctttatttgtaaactctcaatatgatagattacaagtggatacgaacatcgcaatgattcatgcggcagataaacgcgttcatagaatccgggaagcgtatctgccagagttgtctgtgattccaggtgtcaatgcggccattttcgaagaattagagggacgtatttttacagcgtattccttatatgatgcgagaaatgtcattaaaaatggcgatttcaataatggcttattatgctggaacgtgaaaggtcatgtagatgtagaggagcaaaacaaccaccgttcggtccttgttatcccagaatgggaggcagaagtgtcacaagaggttcgtgtctgtccaggtcgtggctatatccttcgtgtcacagcatataaagagggatatggagagggctgcgtaacgatccatgagatcgaagacaatacagacgaactgaaattcagcaactgtgtagaagaggaagtatatccaaacaacacagtaacgtgtaataattatactgggactcaagaagaatatgagggtacgtacacttctcgtaatcaaggatatgacgaagcctatggtaataacccttccgtaccagctgattacgcttcagtctatgaagaaaaatcgtatacagatggacgaagagagaatccttgtgaatctaacagaggctatggggattacacaccactaccggctggttatgtaacaaaggatttagagtacttcccagagaccgataaggtatggattgagatcggagaaacagaaggaacattcatcgtggatagcgtggaattactccttatggaggaatag

SEQ ID NO: 40 - protein, 1189 aa, Artificial
  Synthetic Construct
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIACLEGLGNNFNIYVEAFKEWEEDPNNPATRTRVIDRFRILDGLLERCIPSFAISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 41 - DNA, 3417 bp, Artificial
  Pesticidal protein TIC844.
  CDS (1)..(3417)
atggaaataaataatcaaaaccaatgtgtgccttacaattgtttaagtaatcctaaggagataatattaggcgaggaaaggctagaaacagggaatactgtagcagacatttcattagggcttattaattttctatattctaattttgtaccaggaggaggatttatagtaggtttactagaattaatatggggatttatagggccttcgcaatgggatatttttttagctcaaattgagcaattgattagtcaaagaatagaagaatttgctaggaatcaggcaatttcaagattggaggggctaagcaatctttataaggtctatgttagagcgtttagcgactgggagaaagatcctactaatcctgctttaagggaagaaatgcgtatacaatttaatgacatgaatagtgctctcataacggctattccactttttagagttcaaaattatgaagttgctcttttatctgtatatgttcaagccgcaaacttacatttatctattttaagggatgtttcagttttcggagaaagatggggatatgatacagcgactatcaataatcgctatagtgatctgactagccttattcatgtttatactaaccattgtgtggatacgtataatcagggattaaggcgtttggaaggtcgttttcttagcgattggattgtatataatcgtttccggagacaattgacaatttcagtattagatattgttgcgttttttccaaattatgatattagaacatatccaattcaaacagctactcagctaacgagggaagtctatctggatttaccttttattaatgaaaatctttctcctgcagcaagctatccaaccttttcagctgctgaaagtgctataattagaagtcctcatttagtagactttttaaatagctttaccatttatacagatagtctggcacgttatgcatattggggagggcacttggtaaattctttccgcacaggaaccactactaatttgataagatcccctttatatggaagggaaggaaatacagagcgccccgtaactattaccgcatcacctagcgtaccaatatttagaacactttcatatattacaggccttgacaattcaaatcctgtagctggaatcgagggagtggaattccaaaatactataagtagaagtatctatcgtaaaagcggtccaatagattcttttagtgaattaccacctcaagatgccagcgtatctcctgcaattgggtatagtcaccgtttatgccatgcaacatttttagaacggattagtggaccaagaatagcaggcaccgtattttcttggacacaccgtagtgccagccctactaacgaagtaagtccatctagaattacacaaattccatgggtaaaggcgcatactcttgcatctggtgcctccgtcattaaaggtcctggatttacaggtggagatattctgactaggaatagtatgggcgagctggggaccttacgagtaaccttcacaggaagattaccacaaagttattatatacgtttccgttatgcttcggtagcaaataggagtggtacatttagatattcacagccaccttcgtatggaatttcatttccaaaaactatggacgcaggtgaaccactaacatctcgttcgttcgctcatacaacactcttcactccaataaccttttcacgagctcaagaagaatttgatctatacatccaatcgggtgtttatatagatcgaattgaatttataccggttactgcaacatttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaa

SEQ ID NO: 42 - protein, 1139 aa, Artificial
  Synthetic Construct
MEINNQNQCVPYNCLSNPKEIILGEERLETGNTVADISLGLINFLYSNFVPGGGFIVGLLELIWGFIGPSQWDIFLAQIEQLISQRIEEFARNQAISRLEGLSNLYKVYVRAFSDWEKDPTNPALREEMRIQFNDMNSALITAIPLFRVQNYEVALLSVYVQAANLHLSILRDVSVFGERWGYDTATINNRYSDLTSLIHVYTNHCVDTYNQGLRRLEGRFLSDWIVYNRFRRQLTISVLDIVAFFPNYDIRTYPIQTATQLTREVYLDLPFINENLSPAASYPTFSAAESAIIRSPHLVDFLNSFTIYTDSLARYAYWGGHLVNSFRTGTTTNLIRSPLYGREGNTERPVTITASPSVPIFRTLSYITGLDNSNPVAGIEGVEFQNTISRSIYRKSGPIDSFSELPPQDASVSPAIGYSHRLCHATFLERISGPRIAGTVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 43 - DNA, 3420 bp, Artificial
  Disabled toxin DT13.
  CDS (1)..(3420)
atggaaataaataatcaaaaccaatgtgtgccttacaattgtttaagtaatcctaaggagataatattaggcgaggaaaggctagaaacagggaatactgtagcagacatttcattagggcttattaattttctatattctaattttgtaccaggaggaggatttatagtaggtttactagaattaatatggggatttatagggccttcgcaatgggatatttttttagctcaaattgagcaattgattagtcaaagaatagaagaatttgctaggaatcaggcaatttcaagattggaggggctaagcaatctttataagtgctatgttagagcgtttagcgactgggagaaagatcctactaatcctgctttaagggaatgtatgcgtatacaatttaatgacatgaatagtgctctcataacggctattccactttttagagttcaaaattatgaagttgctcttttatctgtatatgttcaagccgcaaacttacatttatctattttaagggatgtttcagttttcggagaaagatggggatatgatacagcgactatcaataatcgctatagtgatctgactagccttattcatgtttatactaaccattgtgtggatacgtataatcagggattaaggcgtttggaaggtcgttttcttagcgattggattgtatataatcgtttccggagacaattgacaatttcagtattagatattgttgcgttttttccaaattatgatattagaacatatccaattcaaacagctactcagctaacgagggaagtctatctggatttaccttttattaatgaaaatctttctcctgcagcagtatatccaaccttttcagctgctgaaagtgctataattagaagtcctcatttagtagactttttaaatagctttaccatttatacagatagtctggcacgttctgcatattggggagggcacttggtaaattctttccgcacaggaaccactactaatttgataagatcccctttatatggaagggaaggaaatacagagcgccccgtaactattaccgcatcacctagcgtaccaatatttagaacactttcatatccaacaggccttgacaattcaaatcctgtagctggaatcgagggagtggaattccaaaatactataagtagaagtatctatcgtaaaagcggtccaatagattcttttagtgaattaccacctcaagatgccagcgtatctcctgcaattgggtatagtcaccgtttatgccatgcaacatttttagaacggattagtggaccaagaatagcaggcaccgtattttcttggacacaccgtagtgccagccctactaacgaagtaagtccatctagaattacacaaattccatgggtaaaggcgcatactcttgcatctggtgcctccgtcattaaaggtcctggatttacaggtggagatattctgactaggaatagtatgggcgagctggggaccttacgagtaaccttcacaggaagattaccacaaagttattatatacgtttccgttatgcttcggtagcaaataggagtggtacatttagatattcacagccaccttcgtatggaatttcatttccaaaaactatggacgcaggtgaaccactaacatctcgttcgttcgctcatacaacactcttcactccaataaccttttcacgagctcaagaagaatttgatctatacatccaatcgggtgtttatatagatcgaattgaatttataccggttactgcaacatttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 44 - protein, 1139 aa, Artificial
  Synthetic Construct
MEINNQNQCVPYNCLSNPKEIILGEERLETGNTVADISLGLINFLYSNFVPGGGFIVGLLELIWGFIGPSQWDIFLAQIEQLISQRIEEFARNQAISRLEGLSNLYKCYVRAFSDWEKDPTNPALRECMRIQFNDMNSALITAIPLFRVQNYEVALLSVYVQAANLHLSILRDVSVFGERWGYDTATINNRYSDLTSLIHVYTNHCVDTYNQGLRRLEGRFLSDWIVYNRFRRQLTISVLDIVAFFPNYDIRTYPIQTATQLTREVYLDLPFINENLSPAAVYPTFSAAESAIIRSPHLVDFLNSFTIYTDSLARSAYWGGHLVNSFRTGTTTNLIRSPLYGREGNTERPVTITASPSVPIFRTLSYPTGLDNSNPVAGIEGVEFQNTISRSIYRKSGPIDSFSELPPQDASVSPAIGYSHRLCHATFLERISGPRIAGTVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 45 - DNA, 3600 bp, Artificial
  Pesticidal protein TIC868.
  CDS (1)..(3600)
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 46 - protein, 1199 aa, Artificial
  Synthetic Construct
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 47 - DNA, 3600 bp, Artificial
  Disabled toxin DT14.
  CDS (1)..(3600)
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatataaacttagaacttgattttcttgatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 48 - protein, 1199 aa, Artificial
  Synthetic Construct
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYINLELDFLDAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 49 - DNA, 3516 bp, Artificial
  Pesticidal protein TIC842.
  CDS (1)..(3516)
atggcagagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaaatttatattgaagcactaagagagtgggaagcaaatcctaataatgcacaattaagggaagatgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacgctaactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaatacaattgatccggagaggattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacatttgaagcagaatatgatttagaaagagcacaaaaggcggtgaatgcgctgtttacttctataaaccaaatagggataaaaacagatgtgacggattatcatattgatcaagtatccaatttagtggattgtttatcagatgaattttgtctggatgaaaagcgagaattgtccgagaaagtcaaacatgcgaagcgactcagtgatgagcggaatttacttcaagatccaaacttcaaaggcatcaataggcaactagaccgtggttggagaggaagtacggatattaccatccaaagaggagatgacgtattcaaagaaaattatgtcacactaccaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 50 - protein, 1171 aa, Artificial
  Synthetic Construct
MAENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNALFTSINQIGIKTDVTDYHIDQVSNLVDCLSDEFCLDEKRELSEKVKHAKRLSDERNLLQDPNFKGINRQLDRGWRGSTDITIQRGDDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 51 - DNA, 3516 bp, Artificial
  Disabled toxin DT15.
  CDS (1)..(3516)
atggcagagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaatgttatattgaagcactaagagagtgggaagcaaatcctaataatgcacaattaagggaatgtgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacgctaactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaatacaattgatccggagaggattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacatttgaagcagaatatgatttagaaagagcacaaaaggcggtgaatgcgctgtttacttctataaaccaaatagggataaaaacagatgtgacggattatcatattgatcaagtatccaatttagtggattgtttatcagatgaattttgtctggatgaaaagcgagaattgtccgagaaagtcaaacatgcgaagcgactcagtgatgagcggaatttacttcaagatccaaacttcaaaggcatcaataggcaactagaccgtggttggagaggaagtacggatattaccatccaaagaggagatgacgtattcaaagaaaattatgtcacactaccaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 52 - protein, 1171 aa, Artificial
  Synthetic Construct
MAENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYECYIEALREWEANPNNAQLRECVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNALFTSINQIGIKTDVTDYHIDQVSNLVDCLSDEFCLDEKRELSEKVKHAKRLSDERNLLQDPNFKGINRQLDRGWRGSTDITIQRGDDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 53 - DNA, 2370 bp, Bacillus thuringiensis
  CDS (1)..(2370)
  misc_feature (1)..(2370): Pesticidal protein Vip3A.
atgaacaagaacaacaccaagctgagcacccgcgccctgccgagcttcatcgactacttcaacggcatctacggcttcgccaccggcatcaaggacatcatgaacatgatcttcaagaccgacaccggcggcgacctgaccctggacgagatcctgaagaaccagcagctgctgaacgacatcagcggcaagctggacggcgtgaacggcagcctgaacgacctgatcgcccagggcaacctgaacaccgagctgagcaaggagatccttaagatcgccaacgagcagaaccaggtgctgaacgacgtgaacaacaagctggacgccatcaacaccatgctgcgcgtgtacctgccgaagatcaccagcatgctgagcgacgtgatgaagcagaactacgccctgagcctgcagatcgagtacctgagcaagcagctgcaggagatcagcgacaagctggacatcatcaacgtgaacgtcctgatcaacagcaccctgaccgagatcaccccggcctaccagcgcatcaagtacgtgaacgagaagttcgaagagctgaccttcgccaccgagaccagcagcaaggtgaagaaggacggcagcccggccgacatcctggacgagctgaccgagctgaccgagctggcgaagagcgtgaccaagaacgacgtggacggcttcgagttctacctgaacaccttccacgacgtgatggtgggcaacaacctgttcggccgcagcgccctgaagaccgccagcgagctgatcaccaaggagaacgtgaagaccagcggcagcgaggtgggcaacgtgtacaacttcctgatcgtgctgaccgccctgcaggcccaggccttcctgaccctgaccacctgtcgcaagctgctgggcctggccgacatcgactacaccagcatcatgaacgagcacttgaacaaggagaaggaggagttccgcgtgaacatcctgccgaccctgagcaacaccttcagcaacccgaactacgccaaggtgaagggcagcgacgaggacgccaagatgatcgtggaggctaagccgggccacgcgttgatcggcttcgagatcagcaacgacagcatcaccgtgctgaaggtgtacgaggccaagctgaagcagaactaccaggtggacaaggacagcttgagcgaggtgatctacggcgacatggacaagctgctgtgtccggaccagagcgagcaaatctactacaccaacaacatcgtgttcccgaacgagtacgtgatcaccaagatcgacttcaccaagaagatgaagaccctgcgctacgaggtgaccgccaacttctacgacagcagcaccggcgagatcgacctgaacaagaagaaggtggagagcagcgaggccgagtaccgcaccctgagcgcgaacgacgacggcgtctacatgccactgggcgtgatcagcgagaccttcctgaccccgatcaacggctttggcctgcaggccgacgagaacagccgcctgatcaccctgacctgtaagagctacctgcgcgagctgctgctagccaccgacctgagcaacaaggagaccaagctgatcgtgccaccgagcggcttcatcagcaacatcgtggagaacggcagcatcgaggaggacaacctggagccgtggaaggccaacaacaagaacgcctacgtggaccacaccggcggcgtgaacggcaccaaggccctgtacgtgcacaaggacggcggcatcagccagttcatcggcgacaagctgaagccgaagaccgagtacgtgatccagtacaccgtgaagggcaagccatcgattcacctgaaggacgagaacaccggctacatccactacgaggacaccaacaacaacctggaggactaccagaccatcaacaagcgcttcaccaccggcaccgacctgaagggcgtgtacctgatcctgaagagccagaacggcgacgaggcctggggcgacaacttcatcatcctggagatcagcccgagcgagaagctgctgagcccggagctgatcaacaccaacaactggaccagcaccggcagcaccaacatcagcggcaacaccctgaccctgtaccagggcggccgcggcatcctgaagcagaacctgcagctggacagcttcagcacctaccgcgtgtacttcagcgtgagcggcgacgccaacgtgcgcatccgcaactcccgcgaggtgctgttcgagaagaggtacatgagcggcgccaaggacgtgagcgagatgttcaccaccaagttcgagaaggacaacttctacatcgagctgagccagggcaacaacctgtacggcggcccgatcgtgcacttctacgacgtgagcatcaagtag

SEQ ID NO: 54 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 55 - DNA, 2370 bp, Artificial
  Disabled toxin DT16.
  CDS (1)..(2370)
atgaacaagaacaacaccaagctgagcacccgcgccctgccgagcttcatcgactacttcaacggcatctacggcttcgccaccggcatcaaggacatcatgaacatgatcttcaagaccgacaccggcggcgacctgaccctggacgagatcctgaagaaccagcagctgctgaacgacatcagcggcaagctggacggcgtgaacggcagcctgaacgacctgatcgcccagggcaacctgaacaccgagctgagcaaggaaatccttaagatcgccaacgagcagaaccaagttctgaacgacgtgaacaacaagctggacgcaatcaacaccatgctgcgcgtttacctgccgaagatcaccagcatgctgagcgacgtgatgaaacagaactacgccctgagcctgcagatcgagtacctgagcaagcagctgcaggagatcagcgacaagctggacattatcaacgtgaacgtcctgatcaactgtacctgtaccgagatcaccccggcctaccagcgcatcaagtacgtgaacgagaagttcgaggagctgaccttcgccaccgagaccagcagcaaggtgaagaaggacggcagcccggccgacatcctggacgagctgaccgagctgaccgagctggcgaaaagcgtgaccaagaacgacgtggacggcttcgagttctacctgaacaccttccacgacgtgatggtgggcaacaacctgttcggccgcagcgccctgaagaccgccagcgagctgatcaccaaggagaacgtgaagaccagcggcagcgaggtgggcaacgtgtacaacttcctgatcgtgctgaccgccctgcaggcccaggccttcctgaccctgaccacctgtcgcaagctgctgggcctggccgacatcgactacaccagcatcatgaacgagcacttgaacaaggagaaggaggagttccgcgtgaacatcctgccgaccctgagcaacaccttcagcaacccgaactacgccaaggtgaagggcagcgacgaggacgccaagatgatcgtggaggctaagccgggccacgcgttgatcggcttcgagatcagcaacgacagcatcaccgtgctgaaggtgtacgaggccaagctgaagcagaactaccaggtggacaaggacagcttgagcgaggtgatctacggcgacatggacaagctgctgtgtccggaccagagcgagcaaatctactacaccaacaacatcgtgttcccgaacgagtacgtgatcaccaagatcgacttcaccaagaagatgaagaccctgcgctacgaggtgaccgccaacttctacgacagcagcaccggcgagatcgacctgaacaagaagaaggtggagagcagcgaggccgagtaccgcaccctgagcgcgaacgacgacggcgtctacatgccactgggcgtgatcagcgagaccttcctgaccccgatcaacggctttggcctgcaggccgacgagaacagccgcctgatcaccctgacctgtaagagctacctgcgcgagctgctgctagccaccgacctgagcaacaaggagaccaagctgatcgtgccaccgagcggcttcatcagcaacatcgtggagaacggcagcatcgaggaggacaacctggagccgtggaaggccaacaacaagaacgcctacgtggaccacaccggcggcgtgaacggcaccaaggccctgtacgtgcacaaggacggcggcatcagccagttcatcggcgacaagctgaagccgaagaccgagtacgtgatccagtacaccgtgaagggcaagccatcgattcacctgaaggacgagaacaccggctacatccactacgaggacaccaacaacaacctggaggactaccagaccatcaacaagcgcttcaccaccggcaccgacctgaagggcgtgtacctgatcctgaaaagccagaacggcgacgaggcctggggcgacaacttcatcatcctggagatcagcccgagcgagaagctgctgagcccggagctgatcaacaccaacaactggaccagcaccggcagcaccaacatcagcggcaacaccctgaccctgtaccagggcggccgcggcatcctgaagcagaacctgcagctggacagcttcagcacctaccgcgtgtacttcagcgtgagcggcgacgccaacgtgcgcatccgcaactcccgcgaggtgctgttcgagaagaggtacatgagcggcgccaaggacgtgagcgagatgttcaccaccaagttcgagaaggacaacttctacatcgagctgagccagggcaacaacctgtacggcggcccgatcgtgcacttctacgacgtgagcatcaagtag

SEQ ID NO: 56 - protein, 789 aa, Artificial
  Synthetic Construct
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINCTCTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 57 - DNA, 3570 bp, Artificial
  Pesticidal protein TIC1100.
  CDS (1)..(3570)
atggagatagtgaataatcagaatcaatgcgtgccttataattgtttgaataatcccgaaatcgaaatattagaaggcggaagaatatcagttggtaataccccaattgatatttctctttcgcttactcagtttcttttgagtgaatttgtcccaggtgcggggtttgtattaggattaattgatttaatatggggatttgtaggtccttcccaatgggacgcatttcttgctcaagtggaacagttaattaaccaaagaatagcagaagctgtaagaaatacagcaattcaggaattagagggaatggcacgggtttatagaacctatgctactgcttttgctgagtgggaaaaagctcctgatgacccagagctaagagaagcactacgtacacaatttacagcaactgagacttatataagtggaagaatatccgttttaaaaattcaaacttttgaagtacagctgttatcagtgtttgcccaagctgcaaatttacatttatctttattaagagacgttgtgttttttgggcaaagatggggtttttcaacgacaaccgtaaataattactacaatgatttaacagaagggattagtacctatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatga

SEQ ID NO: 58 - protein, 1189 aa, Artificial
  Synthetic Construct
MEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 59 - DNA, 3570 bp, Artificial
  Disabled toxin DT17.
  CDS (1)..(3570)
atggagatagtgaataatcagaatcaatgcgtgccttataattgtttgaataatcccgaaatcgaaatattagaaggcggaagaatatcagttggtaataccccaattgatatttctctttcgcttactcagtttcttttgagtgaatttgtcccaggtgcggggtttgtattaggattaattgatttaatatggggatttgtaggtccttcccaatgggacgcatttcttgctcaagtggaacagttaattaaccaaagaatagcagaagctgtaagaaatacagcaattcagtgtttagagggaatggcacgggtttatagaacctatgctactgcttttgctgagtgggaaaaagctcctgatgacccagagctaagagaagcactacgtacacaatttacagcaactgagacttatataagtggatgtatatccgttttaaaaattcaaacttttgaagtacagctgttatcagtgtttgcccaagctgcaaatttacatttatctttattaagagacgttgtgttttttgggcaaagatggggtttttcaacgacaaccgtaaataattactacaatgatttaacagaagggattagtacctatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatga

SEQ ID NO: 60 - protein, 1189 aa, Artificial
  Synthetic Construct
MEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQCLEGMARVYRTYATAFAEWEKAPDDPELREALRTQFTATETYISGCISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 61 - DNA, 3564 bp, Artificial
  Pesticidal protein TIC867.
  CDS (1)..(3564)
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccttcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 62 - protein, 1187 aa, Artificial
  Synthetic Construct
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 63 - DNA, 3564 bp, Artificial
  Disabled toxin DT18.
  CDS (1)..(3564)
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatataaacttagaacttgattttcttgatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccttcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 64 - protein, 1187 aa, Artificial
  Synthetic Construct
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYINLELDFLDAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

---

What is claimed is:

1. A method for selecting a first FFPP (fully functional pesticidal polypeptide) and a second FFPP that are compatible for use together in a composition for controlling a target pest, said method comprising:

a) selecting the first FFPP, which is toxic to a target pest and the second FFPP that is toxic to the target pest and is different from said first FFPP, wherein each of the first FFPP and the second FFP have toxic properties when provided individually in a diet of the target pest;

b) producing a first DT (disabled protein) from said first FFPP that, upon ingestion by said target pest, blocks the toxic properties conferred by said first FFPP;

c) producing a plurality of different mixtures containing a fixed but pesticidally effective amount of the second FFPP and increasing amounts of said first DT;

d) providing a dose of each mixture of step c) in the diet of at least three different individuals of said target pest; wherein observing toxic properties in any individual in step d) is determinative that said first and second toxic agents are compatible for use together to control said target pest.

2. The method of claim 1, wherein the composition comprising said first FFPP and said second FFPP is effective in controlling an insect pest infestation wherein said insects are selected from the group consisting of Arachnida, Coleoptera, Ctenocephalides, Diptera, Hemiptera, Heteroptera, Homoptera, Hymenoptera, Lepidoptera and Thysanoptera insects.

3. The method of claim 1, wherein the first FFPP and the second FFPP bind to different receptors in the target pest.

4. The method of claim 1, wherein preparing the first DP comprises the step of confirming that said first DP when used alone in a bioassay with said target pest has diminished toxicity against the target pest when compared to the toxicity of the first FFPP.

5. The method of claim 1, wherein the method identifies a combination of two FFPPs that has a decreased likelihood of development of resistance by said target pest against any one of the FFPPs relative to a combination that has not been selected by the method.

6. The method of claim 1, wherein the method identifies a combination of two FFPPs that has a delayed onset of resistance by said target pest against any one of the FFPPs relative to a combination that has not been selected by the method.

7. The method of claim 1, wherein the first DT does not itself confer toxic properties.

8. The method of claim 1, wherein the plurality of different mixtures comprises a plurality of molar ratios in which the first DP is present in a greater concentration than said second FFPP.

* * * * *